United States Patent 11,400,116 (SYSTEMS AND METHODS FOR TARGETING CANCER CELLS) - sequence listing, part 4

SEQ ID NO: 7191 - DNA, 407490 bp, Homo sapiens
gatccacggcaggcgcagggcaaagccaggcccattgccaatgcaccagccctccctacaaggctcctaccacctggccactgctgcagcccgtccatcgctctaagcctgacccccaaccctggctgcagccgcctgccctcctagcgcagccgctctcctaccgctctggtgtaccgcagtctctgtcactgccgcccacccgcagtgaggcgagccatggtgttgcaggctctaggtgtctcctcctcctggcacagagcagctgggcgggcaaagccagaaaagcctagagaaagatgtgaggggtggaagggttagagcctcaacttgtcatgccggccactgggtggcaggggccagtttcagcaaaggcactcacacccaccctccaaagtccagcctctccttttggcccaagctgggcaggaactggggtctggggtgggtgctggagacaccacagcatccagctccccactccacaggaaccattgggcccactgggctgcactcctcagggagcaggagaagcagaaaaattcagacccagccagccctccacacccaggtgccaattcctgttccggacgcctccacgcacagggccctgtcccccgtggtgtccccaggggtgcctggcagcctctgaggcacagacccacagtacacaggcccaggaaccacggtgggtgtgggggctctgccatgctcaggattcccacgcaaatgctgcgtgccctgctgcactccagtatgaccaagagtgggtcgccctctggagtgtggagtcagggagaggagaaccactccttccttggatgccaactctgttgaccgacaccagcagtgcagcccctgatagcaccgaactcgcccccgctccacggctagtcctgccctcaatagcgccccccacctccgtcccccaatgccgccagtagcgtataaccgatagtgccctaacctgtcctcctccatgggcattgcagccccagagagcacccataacccaccctccctgccatgggcagtgcagccctgtacagtgctaccaaccagtacccctaatgcaggcaatgacaccctggatagcgccctcaacccaccccacactgcgaaaggtacagccctggatagcccctgtcctaccactctggtcgtcctgtagtctctgtcaccaccaccaccaaccacagtgaggcaagccagtgggccacaggctctaggacccagcagccaggcatggagcagctctcgctgatggccagctcctaccactctgaccacgctgctgtctgtctccgtggccatcttctttcactacaaaggaataaaactaggtatcaataagaaaagcaattttggaaacaatacaatcacatggaagttaaacaccaccctcctgaataaatgactagtgggtcaatgaagatactaagacagaaattcaaaaatttcatgaaacaaagggtaatgaaaacacagtataccaaaacttgttatgcagaaagcagtacaaaggcagagatttacagctataagtgcctaccatccaaacaaaagaaaaccttcaaataaacaatacatcttaaagaactagtaaagaacaaactaaactgaaaataagaaaataaataagatcatagcacaaacaaaattgaaataaaaaacagacaagattaaacgaaaagttggttttctggaaagctaaacaaaattgacaaacttttaaccaggctaagaaaagagacaagattcaaataaataaaatcaacagattaaaaaaaggagacattacaactaatacttcagaaattcaaaggatcataactggctactatatgccaataaattggaaagcctagtagaaattggcaaattcctagatgcatacaacctactttggttaaacaatgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacgaatcctgctcaaactattttgaaaaacaggagggaatacttccaaacttattctatgagaccattattactgtgataccaaaatcagacaaaagcatcaaagaaggaaactacaggccaggatctctaatatggatgcaaaaatcctcaacaaaataccagtgaatcaaattcagtaatacattaaaaagataattcatcatgatcaagtgggatgtatccctgggacccaagggtcactcaacatacaatgtgatacatcatatcaaccaaataaacgacaaaaacagtatcatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaatggaaagcttttcctctaagatctggaacatgataaggatgccccctgtcaccactgttgtttaacatagtaccagaaatcctagctaaagccatcagtgcagcccctgatatggcccccaacccaccctgccccctaccaccagcagtgtcacccccccaatagcacacccaacatacccaaactgccctgcctccccacaccatgggcattacagcaccccatagcgccctcaacccgaaactgccacccccccgacagccgcacagtgcagccccggatagcacacttagcccacctcactgttgccagcaatacagtctgggatagtgcccccaaccggctccccaccaaaggcagtgcagccccggtttggcccccaaaccacccccccccccgcccggtgcaggcagcacagccccagatagcacacccaaccggccacccaagacgggcagtgacgcctgagatagggctcccaacccgtcccaggccacccacagtgcagcctggatagcgcacttaccccgacgtctttctacgctctggctggctgcagtgtccatcgctgccaccaaccacaaacagggctgcaaacaggaaggattttattcaccgtccatgcggccccgagttgtcccaaagcgaggcagtgcccccaaggtctgtgcagagcagaacgcagctccgccctcgcggtgccaccagcccgcctgcccgggtctctgctgaggagaacattgctctgccttcgctgtatctccgaagtctgtgcagaggagaactcagctccgccctcgcaatgctctccgggtctgtgctgaggagaacgcagctccgccctcgcaaaggcacacagcgctggcgccggcgtggcggagaggcggccagcggcggagaggcggccagcggcggagaggcggccagcggcggcgcggtggagaggcggacagcggcggagaggcggacagcggcagcgcagcggagagacggacagcggcggagaggcagacagcggcagcgcggcggagaggcggccagcggcggagaggcggacagtggcggagaggcggacagcggcggcgcggcggagaggcggacagcggcggagaggcggacagcggcggagaggcggacagcggcagcgcggcggagagacggacagcggcggagaggcagacagtggcggcgaggcgcgcagcggcggcgcaggcgcggagaggcgctggcgccggctctggctcggagaggcgcaggcccaggctccactccccagctgtgaaagggtaagaaccaagggtggctgagactcggggttgttcagggccgggtgggctctggacccagcaggcccggcacccaggtcagggctccaggggaggccaggtgggcgaaggccaagaaggggctggggctggtcaggaagggctcctggtgaccagagcactttgcgtgagccagcgtgggaggaaggtgggctggatgagccagggaggcgccgggaggggccttggcagaggcgaccccctccgtcacccccaggccactgaaccctgggtagcgagaaccgacaggggaggctgcagacagaggagtggaggctccccggcttttggggctctgagtagaagcatctagggggtccctcaagaggcccccagacgcttccccatggtgagaaaagaaggcgcagagaggggcacggcgccggcgcagaggggcacacagcgagatttgctgtgagttcttttattgccccaagtgtacctcatcttggtagatttctattggctttaaaaatgtgtgtgttttgctgttggggagtggggtattatacggatgtcagattttgctggttgactgttcagatcttttgtaaatccttgctccttttctgcctagtttcactctgtcacttacactagagtgcggtggcacgaacatgactcactgcagccttgacttcctagggtcaagtacttcccctggcttaacttcctgagtagctggtactataggtgtgtgccgccacacctggctaaatttaaaattttttggagagatgaggccttgctatgttgcccaggctcgaactcctggcctcaagctatcctttgtttttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcgcatatacccacagctcagaggaggacactgcatgccacacagggtcagatgggcaccgcactctgtagcggagtgagggctgcgggctgaggaagcaggcgggcttggtagtaacaagagcacacaatgaccaatggttcccaagggggaatgcaattggcttgtttgaataaattcatgggctcgcagacaggtgaagtgaaacttcttaggctgaggtgcaactgttctggctgataaaagaactagccaggtggggagcctttcctgttgggtggcagggtagggggtgtctgatagaaacaggaaaacccacggctaggcctttggggccctgtgaggctcaaagatgtcaaggcagcataggaaattttagatcttaaaattcagcgaagaccctctccagctctggtacattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttaaagtgtttgctctggatgttacaatatgtgtattgtaatatagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctcatctttcctttgtccctcctcccatagtcccatattcatcccttctgcataagaactttctatagccattttttttattttgatttttttgttttaattttttgtattgtggaaatgacagaacatatttccgtagccattttttagcatttctaaattgaccagtgacaaattcctatattctcttcctctgagaatgtctttatttctctcttcatttctgaagggtagtttcatgggatatagaatttgcctttcatgtattcagaggttttcagtattcgtataatcaaacctgatagttttccttttggttttgaggttgtgtcttgtttgggtgagtctcctacccctttgactacagaaatgccctttcattttaaatatcctcctattatgaaacacatttccacattttctaaatttttaatttttagctgagaaataaattagtaattatttaagtattaattacttttatcttgttattaattattggttttatttatttacatgtagttggcttacatttagtttagtttaacttaattactttaaagtaatgtataaatatctgcagtttgtacctcatgttctcactcataagtgggagctgaacaatgagaacacgtagacacagggaggggaacatcacacaccaggttctatccaggggttgggggcaagggaaaggagagcattatgacaaatacctaatgcatgcagggcttaaaacctagatgacaaattgataggtgcagcaaaccaccatggcacatgtatacctatgtaataaacctacatgttctgcacatgtatcccagaacttaaagtaaaatttaaaaaaaaaataattaattaaaaatatatatcttcagtttgtaaacgtcccgacaacgcaggaacagagttaaaagagtgtgtgtcgtccttagctgctcccaccccatcgtctcctccctagccaacccagccgccagtctggcgtgcgccttcaaggtttcttcctagacactggcaaacatagatcactattttctgccacatggtatcttttaaacacacacgattgttttgtgcagaaactttctatttttacctctcataagtgtcctgtggattctttccatgtcactgtggtgtgtgtgcgtgtgtgagattcaagttcagcttgctaatcttgtagaaagaattacactccacttcccctgtgctctggccctccctaacacagcagcccatccctggaggctgatggagccccttgagcacctgcttaccatttctgtttgttctgtttattcaggttttctgcctcctgctaagccaatttatacattccaagaaaatcttccatttcatccaggtgaaacagaacctactggaatgaagctggcctcccatggaatgaagctggcctcccgtctccttgatttgaagcagcttctccacgttggttattatgccatttttctaaatctaacattttaaaatttgtgccttttctttctcttttgcttgacttctcagaggtttttttaacggtcttttcaaagaagtggttttcggttttatttatcaagtctacttttattatggctgttttaaaattaaatacatttatttcttgtttctcttaaaaaagcttcttgtatgtttacttagtttatataattttatatgtcttctgttgaagcatattaacaaacacttccagctataacatttcccctgagaactgctttggacacatccagatattttgataggtcacacacttattgtagtttgtttctgaaaagtttttcattttagtttttattttctcttttactcaaattatcatcagctttctccttttatcctgtttctgacaaattaatctgaggatataaatctctccctaaatgtcaattttgttgagtttcataattttaatatgtaataccctattgctattgagttccaggcatttcataattttcattgtgaaaactaactttgtttccaaaacacactttttcttcttttttgagacagagtttcactctgtcgctcaggctggagtgcagtagcacaatctcatctcactgcaacctctgcctcctaagtttaggtgattttgttgcctcagcctccctagtagctgggtttacaggctcttgccactatgcctggctaattttttgtatttttagtagagacagggtttcgtcatgttgcccaggctggtctcgatctcctgacctcgggtgatccacccgcttcagcctctcaaagtgctgcgattacaggcatgagccaccgtgcccggccccaaaatgcacttttaacatggtctttgttattgcatgtttctaattttgttgcaccctggtgagagaatgtgatttgtgtaacagcaattcttgggaaaggggctgaggcttcctgctcctttagcacagctaaattttcccaaacgccatccatgagcttggaaagagcattgtactctgttgggatgggctcaaatctctctgtaaaaatgagtgttcttctgttgttgttgttctgttttttgtttgttttgttttgtttgttttttgtctcagtcgttttgtttgctcagatcttttgatgatccggataatcttttaatttatgcaggatgtttctctgcttgtgcaggctggtgggattggggactggagagaggataagtgtctgcttgcccaggactggcaaactgtcacttgccctggttgtgccttgccaggagctcccgtgcctgtctctgagagtgtcatgagcgcagcggtggtagttgtgtggtggatgcatttcccctaggttggggggtgggtggctggtcctagctctgtttgttgttgccgatgagacacagcacacttctgcttcctgatggatcttgtcagtcatttgacttcttcctggtctgggctcctgagctggccctctgcaggccaagcaggaatggagctggctgctacaagagttccttcactagagggcatctctcctctctcctcccacacatgggaacacaagggtgggctttcctccacccactgtgatccgcagcccggctttcccctcctcaccctctgctctcagacagacttgcttttccctggtgtctgtgagaggtgattcttcatggtgccaagaatgtggatttttttgagagcaggcactctcacagatatttgcacacccatgttcaaagcagcgtgattcacaagagtcaaaaggtagaagcattctgagggtctatgggtgagtggatgggcaagcgaaatgtggttatgcatacagtagactgttactgaatctttaccaggaaggagattcttttttttctttctttttgtggaaaatgcggtctcgctatattgcccaggcaggtctcgaactcctgggttcaagctatcttcctacctctgcctccctaacagctaggataataggcgtgagcctatgatattacccagccaggagggaaattctgagaggtgtgccaacaggcatgaaccttgaggacattgtgctagatggaataagccagccacaaaaggacaaatacattgcgatttcacttacatgaggggcccattatgggcaaattcaaatacagaaagagcaatggttaacaaaaggaggaagttggtgttcaatgggtatggtttccttttgcgaagatgaagaagttctggagatggacggtggtaggggatatgcgacaatgtgagtgcacttaatgccagttataacacggggagtgcgtgtgcacacggctctgggagttctcgtgcagcactcagagctcagcgtgggcgagggcgtcacccctctgggggcgtccatggggccttggagaagggaggctccggggcaccagagcagtctaccgggagaggccgggccgagcgcttgttcacccccagccctcttagggaactttcacatgcttctcccactaggcctaggcacccctccccaccctccctaccctccctaccttcctggttccctgaccctcggtgactgtgtccttcaagactgaactccagagtccccacccgaggacccgcagtgcccagcccccgcgagctcacggggtgtatgcccaccccgaggctccaccgcgcctgtgtgctgggaagcctggctccatgggaccctcgggctctgagcgcgccgtcgctgcagctgccagcagctcctgaggaagtggctcgaggccctggggtgggccaggcgtgcggtgggcccgctgccctcacaccggccccggccgcacacaggaggcgcaatcagcagagacgttggacagggttggacactggctgtctctttcgggcctcggttttcacgtctgaaataaaagcgagcatcctggccctggtgctgtgcctctgccgcggtagaggtttccacccctatgagcccagtgcgccttccaggcttgagggagagggagtgtgcgtgcctgtgaacgcgtcacactcgtgtgaacgcgtcatacgcttgtgaaagactgtgcgtgtgcacacgcgtgtacatgcatgtgaacgcgtcagggtgcctgaggatgcacacatgcacctgtgagtgtgcgcgagtgcgtgctcagaggacagctctcagcaggctggggacctccttcctctcactcctgagggttttgggggaccagcccccgtctccaggtgctgtgggatgccctggggcgagctcgcaccgctgtgctcgggctccggctttgtggggacccggccttcccggcccgcaccacggggagttccacgcagcacccacgaggtggcgccgcagactcgctaccgcggagcgcggcggctcccggctcccagcagccttgcctacagctgtggccagggcgatccctctcaggcccaggccgctgctgccaggaagagcaggaagaacagccagtcacgcctggtgatgcctctgaagtgcttatgctcccaggcatgggctgaccgcaacgtacattctctccttttatgcccctactatttggaacgctgtatttttttcatttttatttttattttttgttgtaaatctgccacttaaaaatacccagggtggagctaaaagtacagacactgctcaacttacccctggctgcggcccgataaggccgctgcgagtggaaaatgactgagtccacctgactaccgaatagcacagcgtaggggggcccaccttggcctgctgagaacactgccctgagcctgcggtgggcagaagcatcaacacgaagcctgttttgtagtcaagtgtcggatacctcatgtaatcattgactgctgtactgaaagcgaaaaactggccgtgtgggactcacacgagggtttctgctgactgtggatggcttttgcatcactataaagttgaaaactgttaagtggaactgcggtaagtcagggctgtgtgcactagagacctgagttctgctgctccatagctgtgtgactttggacacatatttgagcctgagtgtcttccacacaaaatggatttcttagcataacctacacatgtgtacgtgcctgtgagcgtgcacgtgtgtgtttgcatgaacacatctgtgtatgcacgagtgtgtgcacatttgtatgtgtctgtgtaagtccgtatgtacatttgtgtgcatgtctgtgtgtgcatatgtttgtatgtgtgtgtgctatgcatgtgtgtgttaaggccctggggtggagctgaggagttgaggggagatgctgggagggcagccagcaccaggcgtttgttggccaggagagaagctgccatccaggtgcactctggagctcgtgcttcagtggcacaaggctttgggagtgaggaagctgggggctggggcagggcagtcctgcacctcaggggaggtgcagagtgaggccaggaggatggaaagagtgccagagaatgggggaaatctgaggcatcaggaaaggaagacacaggccatggagagggcagctgggccctgggtgaggccggccctcaggaaggaggtgccataggcaggggagtgcccagatggagagcccaggggtatggacccacgggtgtatgacagtgggggtactcctgaaacagagcagtgttatccaacaagcagggttgggacagctagttatttcatttaaaaaaacaggtcaatgtcagtcctcatactgtggtttaaaataagctccagatagactcatgttttacatgtaaagaaaaaaaggcaaaaagaaaataaagaaaaggcttgtaagcaggtagttaattggaggcaatcccagaatgcaggagagaggggaaatacttttagacctaaaatttgaaaaatatagtaaaaatgattcccatatgtgcctctttcagcttgctctaatgtcagcatcataaataaccacagcataagtatcataaccatgaaatgaacatagatataatgttatttgttaactcatttaaaataccatatggatttcactgatttttcccgttgatgactttttttatgttacaagataaaattcaggtttctgtattttatttggttatcctgtccttaatatctttaaatctgtgatagtttttcacttttgtttctctttcatggccttcaaacatttgaagtttactgtccaggtatgttgaagaatgtcctcctagttgggtttgtatatgatgtttactactgatttaattcacaccattaatttttggcaagaataatacagacagatgtatcctcagcgcttcacatcagatgttacataatgtcaacatgtcttataggtggtaataaatgaatatgatcaatgaaatcccatttgaaaggaagttttggacaaaaataatgaaaacaactgcttctatcactctttctactaggtcattgcagacgtcattaggaataatctgtttcttccttatcgaatatgtactttattttaacaaactttaatctttttacagtctactgcatcacagcgaaaattgaagaaataatttagttcacttttaaatggcaaatgtttccataataaccatttgccactgaaatgttgatagcctgaagaaagaaaaagaatgggatttattcagccatggtagtatcttcacatgaacagcttttactgagtcaactatttggataaataaatagaattttctactacttagaatgttgcaaaattcaaatggagcagtgtagcatgcactgagctacctctactgggaaagttaagaaccactgaggctatataaggattcatacagtgagtcactatttctggaaacctgggattctggtgcctcagttgaaaagagtccaagaatcaaagtccaaattattcaatgatttttttttagaactgcaaaatgtccaaatagagcagagacgctaaaactgagtggccaccacattagctgtctgtaaaggaagcagctggtaaaatctagtaaacactgatggtcttgttgaggtttttgtttcatgttgaatcactgtgggaggtaagttataatcctgctgacagtaataaactgcaaaatcttcaggctgcaggctgctgatggtgagagtgaagtctgtcccagacccactgccactgaacctggctgggatgccagtggccctggtggatgcaccatagatgaggagcctgggagcctgcccaggtttctgctggtaccaggataagtagctgctgctaacactctgactggccctgcaggagagggtggctctttcccctggagacaaagacagggtggctggagactgtgtcattacaatttctccggtggtatctgagattggaaataaaacagaaatgcactcatgtaatctagatcaaaccagctgtctttgagtagagccaaaattgttcatctactttgaattttaattatatttcttgctgagcagagaaaactcctgatggagttttcactgatgtgcaaaaccacctcatattcccctcacctgggagccagagtagcaggaggaagaagaagctgtgctggggcttccatggttccatctgggtcctaactgagcagttcctccccagggctctgacccaggcattgatatgggccctggaaggtagggcagctgggagggacatgcaaagcagctggggtgggagctgggcttccagctgcagataccacctgcttcttcctctctgcactgagcatcctgcgccgccttggttgtcaggtcagaaaagtctgttggctcagtctgagtgtagaactcctcccttgtgctcacagaatttcactcctgtgcctttcttctcttcaatcacctaaatacacccgtataatgtttggcacaagtctgttaagaacaatataaaaggctgtgttttcatttctctcttcctgtcctcaatatgcccagtcatctccctaagtgcattattggatcgatggaaatgaagagtctgttagaacttaatcttccagatacacatttttttttttttttttttttttttttttttttttttttgagacggagtctcactctgtcttccaggctagagggcagtggtgcgatctccactcactgcaagctctgcctcccaggttcacgccattctcctgcctcagcctcccgagtggctgggactacaggcgcctgccaccatgcccaactaattttttgtatttttagtagagacggggtttcaccgtgttagccaggatggtctcgatctcctgacctggtgatccacccgccttggcctcccaaagtgctgggattacaggcatgagccaccgcgcccggcccagatacacctttcatttgcttattagtaatgttttctgagggtcctgaagctttccattaacccagatacataccctctttgagttaaaaacttctgtttacagtcacatgtcctggcagccctgacatagatgctccatggcttcccgattgcttgaaattaatcaagtaacttaacttccctgtgtctcggtttccatatctgtgtaactgtgacaatagtggtacctgccttacagtgctgtagacagtttaaagaaaataagataaaacatttacagtagtattcaggacattatgtgtgtggcaattaattttgttttcattgtttaaatgttcagcactacagtcatcatcattataaatatacttaccatggaaattagtcttaaatctaatccaagaatgttttatccacagtcaaattaaattctaaggcattttcttcagtaactgtacacaactcttaaaatcctaatgatttgatcttaatctgtgctaaagtactcagaccttcaatcattcccatccatccctgtctaacgcattacttctcatcatccattatttaaatgttaccctataaacagttcccatgtcctgttgctgtccttctttcttatgtaatctttattctaccttgttatcttttatgttattcttgccccaggactgacaataaggaaaaactaccatcattacttgtagacttgctccagtataattttttcaggcttgttgtcttggaaatgaggactgtgtcttgcaaagaaacatattcattgggtcaatgtgttatgaaataaaagattttatctacttatgatccaataattaatttagactgacttgaacagatttttaatgacaaaaaggagaagacgatataagagaaaaatttaatacaatagaaaacacaagctaatataacacttgcttcatggatttttacatgtatattagacatatgctgggtatatgtgtgcaatgataatctaaaaactgaatgctaagtagcttaaggaatgcctgcattacactgagtcttgcccacttttccagttatgaaaagaaagctacagcactatttgtatgagtatcaaaccttctagatgctgtgatagaggtagagaagatttactgagaccaaagccttggaagtagtagatgcttgttctatgatattatgtggttgtggttgttgttaggaaatacagtgggagtgaaagcaaggagaagatttacaagctctgctcttcctcatactcacaaccccctctagagatggacagatgttggtccaggaatctctgacacctcttagaagccttttgctctttccagaatgtttcctgacaagtattgttttgagtcacagattaggtgaaactaggtgtagaagaaaggactagagcaagggaagaagttttccatcccagacagttgtaggaacagggaaattgaatttttcatagatttatgtgatacttgtatcatgttggggagagaggcatcaaaccaggctcattactgaaagaattattatgttatttaagagagaaagaactgtgaatttcttgtcaaatagatgtttaaaattcaaagctactgattttttttttttttttttttttttggagatagaatctcactctgtcacccaggctggagtgcagtggcacaatcttggctcgctgcaacctccatctctccatttaaagcaattctcctgcctcagcctcccaagtagctgggattacaggtgtgtgccaacatacccagctaattttcatatttttagtagagacggggttttgccatgttggcccggctggtctcaaactcctgacctcaggtgatctgcctgcctcggcttcccaaagtgctggaattgtaggattgagccactgcgcctggccctactgatgtattaatattattcatcttcttgaatacaacaagtggtaaagtgcaaatccacactttaaacttgagatttctactcctatgtgaattatactagtgaggaacaaaaaaattctctattggtggggagatgatgtttgacagcggtcagtttgtgaagcagaggcttatgtcacaggactttttacagtattacatataaacatggtgaatggcctcaaacacagaagaatcagcttttttcatgaggcatactaccaccaagaaagaactgaattgaaacctgtgactacttgatgaagggtgtataaagaagagggaaagatttgggaggccaaggcaggtggaccacgaggtcaggagatcaaaaccatcctggctaacatggtgaaaccccatttccattaaaaatacaaaaaagttagctgggcgtggtggagtcccagctactcgggaggctgaggcaggagaatggcatgaactggggagtcggaggttgcagtgagccaacattgcaccactgcactccagcctgggtgacagaacaagaatctgtctcaaaaaaaaagaagagggaaagaaaaatgacacaaaacacaatatcataaacggaaaggaagaagtcattacacagcctacaggagtcaaaaaataaagagaggatattatgagtaatttgatgtcaactgacttgacaaaagtggtgcagggcaggttcttggcttcactcaggaaggaatgcagcgtaagctggtggtagaagaaaacagctttactgaggtggcagtgttacagctttgtgactgttcttgtgaaacagagctaccacataggcgtgccaagagcagtagcgtaggggcagttttgcactcatatttatccccacttttaatgacatgctaataaaggagtgggttattcagaaatagctagaaaatgagcaataactttcaggtgttgccatggcaatggtaaactgatatggcaatggtgggcatgtgttatggacaggtgcttccagtgtctcttccttgtgtcagccagtcttcaatctggtcctgggttgagtcccacctacctcctatctcattgctccctcagagattagatactcctccttaatcttaaggggactgcagaagagcagagtcccttttctgtaagtgcttcctgctgactttatgggggcaggccttccctagcctttgaggagtaaaaatctttggtacctgaactaaggggcccaatggcacgatgcattcatttgtggggtcagaagacagaatgggttggaagacttatgacagaccgtatcatctttacatgaaatttagaagacataaactttactaggatgttaaacaagaaaattataattggaagagagggaaaaattaatgctcctaggtccacctacagaaccatgttattaatctatgtgtttgcaaaacaacacccttaagttttctgttttataaatggaggttgtggtgtccaccttttgtggctgtaggaccttgtaagaaacagttttaatcctgggcagctgtacccaactagtggcttcctgaagcctaacagtaattaagagtaattaagaatatctgataatggctccttattctggttattattgattcttgggggatcattttgttgttgttgttgttgttttgttgttgttgttgttttttctttgagatggagtctcgctctgttgcccaggctagagtgcagtggcacaatcttggctgggctcactggaacctctgcctccagttttcaagctattttcatgcctcagcctcctgagtggctgggattacacgcatgtaccattttcatgcctcagcctcctgagtggctgggattacacgcatgtaccaccatgcccagctaattttgtaatattagtaaagatatggttttgctatgttggcaaggatgatttcaaactcctggcctaagtgatccgcccatctcagcctcccaaagtgttgagatgaaaacatcacaggagctgatgaaaaaggaaaaggagacagcaatgatcccaggcctttttaaagggagaacaagctgaaagcagcaaaacacaacagttaaatctctaagacactaatctcagaagttttaaaagaaactcattattgtatcacaggcaaaattttttgttttacttgtttttttttttttgagatagagtctcgctttgtcacccaggctggagtgcaatagcatgatcttggctcactgcaacctccacctcctgggtttcagccattctcctgcctcagcctcctgagtcgctagggttacaggtacatgccactgtgcctggctaatttttgtatttttagtagagacgaggttttactatgtttgccagactggtcttcaactcctgacctcaaatgatcctcccaccttggcctcccaaagtgctgggattacaggcatgggccaccatgcccagccttaaagctgtatttttattaagtaaagcgtagaggaaaaagtgtaaataaagtgacagaaggaaaacacaaggctgttatggaaaatgataaccttagggcagaaaacaagaaaaggcaaaccaagatttccatagggtgaggctccaatccacaatcctcggacgaatgtcaatgctaaaaaccttggagcatccagggagtggccaacagtactaaatgctgaaaacccagagtacacgagtatcagcctatgaatgtcccacaccaaatgccaggaaaccctggagtatccaggggctgaccagtgcagaaaatcctggagcctcagtggggtggccaacaatgagccccaaaggcccggttggggccatagaacaatgtgactctggcttcttagagtcaacagaacaggagaattcttacatccaagtgtcctgccttaaacaattgcacaaacataattagtagggacccaaagaaaaaactgcaaagcaaacacatatatcggggcagaaaataagataaaatggctgatggataaataaaatgtcattagaggagaaatgactaagagaaagatcaatgaggatgtagtcaggtgtgctatgggggacttcaaatggactatttagccaaaggccttatttcctggatcatctgatatagggaaggtgggtagatgggacacttacaggtgtgcaggagccaaaatggtgccaagcagtctctaacatgaggcctgcatgaagatctctccaggctccccagcttgggtgggttgagctcccacgggtgaactggtgcatggagcggctggcctgcatgaagcagtggctctgtggccacttacctatctgctcagctccactgcctgtcaggaaagacgatggctcttcaaacagcctttggccagtcttaacagctctgcaatgttagcaactatgtagctttaatcgctgtagcgccgatctcgccctctctcactgatcgctgacttgccacttctccaatagctgtctcgcccattgctgatcgctatgtccatcttctcacaaaatgccatctcttgctgtctcttgctgtcttgcttctccactgtttctgctgtctcaccaccacatcaaacactgcctctcaccatgtcccatttatcctccctccttattaaacatccatctgcatgtccaggcctggcatccccaggctgatgtctctgtcctgggccaggtactggagagtattgttcctccaacttcaccaataagccatggttctctcaaatcaaaccttcttagtgtgccaattttgccaagaaggtttgctgtgcactggttgccaactcacccaaatctagtgagacagaacacccatgcacaaccagttacatgaagtggattactacttacagagtcagcaagagagagcacaaagctgcctgggcctgattgactctagaccttgcataacacaaaaggaccgcagctgagggaccctggaatgcagcccaccctgggttttatgtcttagaatcacatgacacactgggctacagtgttgaaggaattcctgtttctagtagggacagaaacagaacccaggctgttctggccaatcatgccctatctcagaatgttacagttccagaacattctacagttattcctgaaaactacaatcaagaaaaggaaggagactgggttaattcgtgactaaatggaaactgttctgcaaataccacagtgaaatcaaaactcagtatttttgagactgggttatttcacttagtgtaatgtcctctagttccatccatgttgtagcatgtgtcagaatttccctttttaaaactaaataatatggaatagtatgtatattaccacatttggattaccagttccctcctttgtgaacatttgagttgcttctacatttggctactgtgaataatttgcttctgaatgtggatatacaaatatctcctcaatttaatgtcttccattacttgggtatatgtccaaaagtggaattgctgaattatatagtatttctatttttaatccttcgaggaattgccatcttgtttcccacagcaggtgggccatttacatcaccacgacagtgtccacaggagttccagttccctaaattctcaccaagactggtcaccctctgttggaaaaaaacattctaacaggcatcaggtgggttttgttttaatttttctaaggattaataatattgagcatcgtttcctatgctagttatctaaatatccccaaagtatcttctttagggaaatgtctattcatatacttttctcatttttaatcagttattttatttttactgttgacaagtagaatttatttttgtatagtagatattattaaccccttatcagatatgattttcaaatattttcttctattccacatgttgcattttcactgtgtaggttttatcttttgatgcccattttaaatttttatgtagtccaatttatttttttttctacttttgcctgtattttggtgttaaaggtgttagtatttaaatgtctgtaaatattcacttactacgctgagaatgtcacacttcaccttctctctctgatggtggagctaagagtgttacactctcccattttgtcctaggggacagtgaagctaggtgagaacccagtggcttttctgagcttatttgtcttgcgtttttggtgacatggattattgttcacatcagcttcctctggcaagtccacctggaaagcattatatttagcaagaaaaaaggaggctgtgaatgatgtcactgtaagctgtttatattccctgttgcaaatgtcaaatccgtgaagcataaagggatttactagaggatattaaattccttagaaattgttgaaaagccttaagcaacaggctccaggcaaagcctctggaacaattccaagaatggcactgctggcgcaggctggggaggagctcctgctgcctgagactccacattcaagctgtctcctgcaggaaagagagcagctcttctcactactgccccccgaaggacagctgctccgctatcaactgctagagacctgacccctttctctgcagacctgactgtgttgattacatcttcatttcagtctcatgtagattcatctgttttcatggattcaggggctatttctgcccaagtccaccctgtggctttctatcataactacacatctttctacacttgaatttctagtcattactagtatcaacagcaacatgctagaacctcacataaagatttcctttacaaagaacatcatgctccccacgtagaattgtgctccccaaaatgtggggaaagtccaatctgttcagcccaacaccatgtaggataaaaggatcttctctcatgagccgttaatctgtctacttattatttaatttgtgggctaaactataaagattggtaaaaatagcactttgaattcttttggcaaaagggtgtaaagaaaagattaaattatttaacatgactcatttcgttattgtcaccagcttctttcatatttattttattctctagtttctggcaatactttctctatggtagagtctggaaaggctactcctcatgtccttggcttcctaagtcccagatgtggtgaagaatgcccatcaactgtgctactacagagtgcttttggattgagatgagggaggagaaatggctgaactcactcaaatgtgatcattttcttggtctaggtcacagccaggcaacacagtcctctgggcacaatatcatcacttgccatgtttctatcaaaatgaaagtatctttcttgactgtggaaaacataggggtgggggcggggagggtcaagtaatagcaaaaggagtacttggagttgcctgagctgccactctggtttccccaaatgttttcaatccatttcattcatgataataaacacctttctgcctaaccagtcataatgacttttctcagatccaactgattcagtgataaacctatagagaaaaaataaatacacttctccatgtttgagctgaccaggatgctgtccctggtgtttgcacctccatatcccactatgcgtttcatcttctctttgcctcactggtgatccaagtacagggaatgcttcacatgactgtgatccctagaacttcatcctgatgacggttgaaatcttctctgagttttaccagtggaaatggcaataaatagaaacattccagaaggtcccctaggttccatattttctgtacttcctctctaaaatatgtaaaatcaattatgtttgctcttgcttttatggactatatctatggccccagcacacatcctaatgtcctgtcttgacaatttatccagtattttaataaatgtaaatggtcacatgcttatcatatcatttcttccaatttcatggaataatttcacatcaactctttggattaagagccgtcaaccagaaaaccacagccctgaataaatagaaatagagtatttcaagctgttcatttggcataacaatgatgagtctacagctcattttcaagatataaatattctgtttatgggagtgacagcaccattcatacagttactgtttcagagcctccaccatatctgacaggacagcaattcaatagcagaagggtttgtgtgccagctttgcttgactaataatgggtttttctctgtccatagggaaagcacatgacaagagcatgagctacacttcacttcactttttttgaggttaataagttgcttgatccaaagctatattacagaagaacttcctgactctgatgaaagctcttggaaaatcctcaaataatattttatgcagaaatataaccaaaaaggaaggcaaattcatatataggaaaataaccagtgccctcctcacgttacatgaggtctactagtatcacccgacaccagctgttagtctgggccctgatgtgtggcgcaatgttaggggttcaagagacgttattcttcttgacaaaataggtgttcagaagagccagtagccctgtatgtctcagttagttgaaactcatattattgagtccccacagggacctccataaccttggttcaggagacaccttggaaacctgggaaaggtgattgactgaagtccatctgttgaatcatcctcattattaaaagcctcctactcattaacggcatttcgattaatattcacttggaaagcatgtttttattttggctcatttttgaaacgtctagtcatagttctttctgaatcactttgtctgaaatcatcctgttgcatttcttttaagggctgatgatctgtcaaaagcaacagccaatattattacattgctgttctctttgcaatgttatcatcagatgtaatccttgcaggttaaccactgttacgaattttacatttccagggatttcttgacaatggcactgatgtgacgccatccagcatctatttgtgagaactctatttgacaaatcatcactgtgggtgtgaacataatggagactttcataggatgctatggttaatattcaactttagtcaaaatttactctagtcctacccttggagctctactgggttcgaaaaatattttagataaggacaatcatttcatagagttttaaaaataaaggctaaaagaaattttctgtagcaacagtatgaactatatgtagccagcatacccttttttaatggaatataacaaaaattatttaaatgtatttaatttaaataattgtataaatatgcatatataataaataaacgtacttaaatataaatactatacatgtatatttgtagccaacatttcatcagataaatataggtagcttttatgtatcttatacacatatatgcacattttccacaaataaggtaaattttaattttttattgaatactagttttaattttgtcattaattttctcttaataacttcataatttaatactaaatgttcacatttataccaccaacttaagaaaaaatcgtgtgtgtaggtagaggtgtaaatactgtatcaggaaggctttatgcataatgattggtaactggttaaatacacaactcagtggctgataacagtaaacatttgttttcgtgttcatggatgttcacgttcacaatcatctggctgatcaagaaagggctcagctgagtggtttctctgcagggcactgagctcatcttcagcctacagatatgaattgtctgaggacgaggctgaacagcagtgactacacatgacacaatattcttatggcaggtcacaggagtgaacaacatcccaaaccaaactgcacagttgaatttaagtccaataatttctaacatagcttcacatattttaaatatattcctttatttcaatgagtacaaattttgaagaaaatgtttactccatttaattgtagaggtgtttgatcattccatggacaaataattatgctttcaacctttacaattctgaaaagatttgcaaatgtaaatttgcattagtaagaaaataaagctggatgtgttttcaacatgtggctttaaatatatatatatattttaatggcctcagtgggggaaaatcattttaacttatgtaaatatccctttttgcctctcttgtgtcctataaagttgcccaacaagaggtcctcccatgagatttggaaatcagaaaaggatgactcaatattctccattggtacctaaggcagacacaggaacagaggtgagggctggagaaacacctagaaggatgctgcaggaagctgagaacatcaacactcccacccctaaacttccagacaggactgaggaccacatggttagatagcccatacttcaagggcagatgctttctgttttctgagtgagcgccattcaatcctgcttctaatatcaactttcctgactactatatccttggctttgaaaggttgtggtctgaacgttaatcataggcattggttcattcttgttatacccaaaagagccaagaaacccagtggggaaaggcactcagggtgtaaaatattgtttctagaatgcaattgaaataggccctgttatcccatggaactaaggtttatggttttttgaataaacagaaattgactcccccagtcttaaaactcaagatagttacatttgtcttatctgagttcttttttcagtaaaccaaccatcagggctcccagatactatcaaggagctgaaacatacatatcactgaatccggacactgagacatcagaaccttcacccattatgattgcataactgacctcttgcttcctgttgaccaaattatcttccttacccaccccccaaattcctgttttcccacatttcgtccctgttatataaactcttaattgtagttgatcagggagatacattcgcaaatggtgtcccatctccacggctgcagtacctgattaaagcctgtttcttggcaatacttgttttagagattgactttctgtgtggtgagcagcagggtgtacactgaatccctggcattttagtaagaaaattctctgcaaccttcactgctttggcttcttgtaacctgaattcacatttaactgcaacttctgagataacttgatataattctaggattcactttgtccaccactgcttcccagtctgagcttgccagctcccaacccttactagtgccagtgaactttctcaaaatgcaaaaggtaatattttccctttttcataaaacactaaccttctcttcgtacttccaatatattgaagaccactgagttttcctgtgtgtccaatttggcaaacatttctttgcaaataaaacattaaatttagagattctgctctacattttatttagacttcagtagtttagactctaattttctgtattaagacaattcctgcttagaatatctatagtggtttcttctctgttatttgaattccaaccaaagccctaaactagactccttaggtgtcaagatctctgcctttattacatcaggagaggcattgctatgtctgtgcagctggggcttacaaagcaaaaggaattgggttgcagaggtgatttcaggtccccctctaccaataccatcagagtgtggctgcatctgaggaacactctcaggcaatgaaggaatcaggaggagcagctggggcagcccagccttacacatctgcttccctgggggtttttgttcgggtgtgtaacactgtgggagggaaactataatactgttgacagtaataagttgcaaaatcttcagactgcaggcaactgatggtgagagtgaaatctgtcccagatccactgccactgaaccttgatgggaccccactttgcaaagtggatgcagcatagatcaggagctcaggggctttccctggtttttgctgataccaggctaaataactgctaatgccctgactcatccgacaactgatggtgactctgtctcctgtagatgcagagagtaaggatggagactgggtcatccagatgacacatctggcacctgagattggaaacataaaaacaaatatccatacaattaatcatgtagtaagagaatttccctgaagggccaggctgtactgagcacattggctgagtaaattcatagtgttctccttccttacctgggagccagagcagcaggagccccaggagctgagcggggaccctcatgtccatgctgtgtcctgactgggtctgactcctgcatgaagtgtggccagcctattaataaggcttcagtgcaggaggttgtgctctgggaacatgcaaatgagcaggggatggggctgactgggcacagctgcagagctggctcatctcagtaactcagcaccagctcagtgtccccaggtgtcccaggaaagaccagggtagcacaaatttgtctgcagtgaatgtgtttctactggagagtagtttgttatgagaaacattttttatgtatttttttgaaaatttgaaatattcctcaggagtcgacggagtaatgtatttcattggtgtatggggattatttagaatatcttgtttgtaggaaatacatagtaaaatgttaaacagtatgattctcaggacttcaaaagactctcatatgattcgggttagggaaggaggtactttgtcctatacttgcaacatttctgtgagctttaacattgttcctttctaaaaatattaaaaataaaatttattgacatgatgctatacatatttgtaagtattaggtaatggtgttatgccattgttcttatcactataagatcaagcaatttactacagatacagagagatgataccgagtttcctcaatgcatgcagcactcacacatccaccattatcaagagctacaggtctctttaatacccagagactaaattcacttcaccttattcttgttttgggcaccttcattgtctaccttcttttctgtcattgagtattactttccaaagttcttctctcttattgagggtgaccactgcatggagcatgtccctgtcatgcaccaacaatgccactttcttcttttatgttttatcagggacatcatcctgacccagacaccagcctccctgttaacatctttaggaaagagacaatcccttatcaagcaattgccaacttacatggagaaatcagctggatccatatgaacctggacatggatttgcactcattatgtctcacatctctactgtgccaaaaatgtcccagcctggcttagtagcaggggacgtggatccaactacatcagcatcagtgggctgcagcctaggactccacaaaattttactgatgcctgactaggggagacaaatcacagtgctgtagcccaagcacaaaccttcctgctgttttgtaagccacctgaattttaagggaacttgcttatattgggagaaaggaagaaagctccatttgtcctctaaatgtttgctgaaaatgaactgacaaaagaaagactaataagagaaaaggcaagcaaaattcacttaaagtgcagtgggatatcataacggtgtgattactcagataactcaatgagatccagtttttcatacttcctttctagcgaagaggtaattgggaagtgtaggcaacctggagagaatagatgaggatagaagtgcatcctcaaaagaacaggcctgtctggataaaacatcaacttctaatctcttctatttttgattcctattttgtgttaatcttccctgatataaaatttcccaggaagaattttcttgacaatcagtttccttctggagaagctgcttttaagcagataaaggagtgagataaaggagtggagtgagcataccccaacagctaaaactcacaagttagaggatttataagtcagactctaagtctcagattttgtaccgctctcttgcttcataaaaatactttgttattttttaaattttactttaaagaaggacaattttggagaatatattaatttttggtggaatgaataatgtccccaccccaaaagatatccaggtcctcgtctctggaacccaagttttataggagttattaagaaattattttaggcagatagagaggaaaaggcatccttggtaagattttgtttcttttaaagcaactccagacatgtttcttgtctaataggaaagctccggctcttagagccaggctggcaagatttgatatgcaaatgaaggccattagaaactgggtccaccctaacatggctattcctaccttcttcttccttacccctacatgtgcctggcaacatggctgcccccacatatccccatgtgcgtagaacattatgatgccctacatgtgcatattgaaaggctagggtgggagggccagtttttgctcaggctatgtgaataacatgcctggtcaaaccaatcccttgagccctttgcaaatcagacaccacctccttcattctcctcatataagcagccacttttccaccacagatggacttttctctttgttggaatcccctgtccctctgtctctgtacagggtagctgtttagccattttattattccttccttcttacgtattaaacttttctctccttaaaaccactacacatctttctgtggcattttatccaaagcagtgtgagacagaaagaaccctgctgttcctccagtcattggagccatatcataaggattctaccttatgatagatagcaaaaaatgaccttgatagatgtaagttaaggactttgagaataagcttcctggttatccagatgaaatcaatacaatcacaaaggtccttaaaatagaggaggaagattgcagtcagggaggagctgggacaatggggacggatgttgtttgaggaaggaaggggccatggaaccagaaatatgggagcacattgaagataagaagcagagaatccagttctctcctctggagcctccagaaggattacagccctactgacaccttagcattagctcagtgagacttctgacctgcagaactacagggtaatacatttatgttgtgtgaagccaataagactgtggcaatttaaacagcagcgttggaaactaatgcaaggggaagaggtgtctttcagctcactgagtgcgtggctgtcctctgttcttggaaatatttccaccttgttatctggtgtcagacaagagacagagaaaattttttttctgagagaagagctcgtacaaaaattctttttagctagaaattctcttgggaaaatcccatgattatctcttatacgatctgggtatcacggagtttaggggtcagaactcacagcacatgataggaagaagagggttttgttagtttgttttcatattaggagggaaaattagattttcaggacacaatctgagagggacagactgagtcagagctattgtaagagaaagaggagatgtggaaggagtcagagcaatgaaacatgtgtccctgcttccaaatctaaaataaagtcattgattttagaaggtgaagcaaagctcttcaccttccatcttcttatgaaggatcaaattctacccagagttcctgtccctcctttactcccctgacattgcattgtggagctaatcacatgtgccttaatccctgctcctgtcccgggctgggagaggctcactgtcctcaccatgcccagcaggctagagctcatgccctaggtaccaaaggagaagaggatggtttctgtacaggaggtaagagctttaccacatgttacatttcactataattctaagtaaagttgtgtggagagaagagaacatatgggcaactctgtctggtagagttggaagagggcagtttctgagagtgacaatgaattcacatttctaaattttcagatggcaaatgctagctttagcaattgtggaaatgtggactttgagtttaagaacaagacagactttcagatactgcaataaatgaggagacatttggaatagggtccttagcccagggctaaggtcaggctggcagtgcctgagagctgccaggcactggccctgggctgtggaggaagcagctgctctcctgagccacagggctgagaatctgagaggaaccacaggccctggccacatggctgcctggcaggggcttcagggaaggaaactgctcacaaattcaggggagctgcattaagcatatatcccccagcctggcaagagtaaaagtctcagagacccagaccttagggctggtgctgggatcctgggctggctgctgtcagctctgccctccctcgtgctaaatgactgggaccctgctggagccaaaaacagacagtcagcaaatgtccttaaagtctttactcagccagactctattctgcttggtaagaaaagaaacacacgctacacaaataagcataaaattatatgtatctgtaatatgaatttctattgtgaactttacatattgaatacatatttaagaaataagttgtatttatatatttgtatatactacgtatttatgaataaatatgtgatgcatgtttatatataaagagatacaactttggttgctagtatatggtacagttttaaacttcaataaattgaacatgaacattgaaaatgagcactgggtgcaccacctcatggccctcctcactccagggcctgagggtcataaagctcaggaccctcttccatgttccccctgggctgagagaagtgaactgcccattgctgaggatcatgagtgacctgaggggggtctacggaatcacagagcagcagatgcccaggaaatggatagtgggtctgggccctgaatggagggacgttttgtttccagagctcagcatagacaagtcctcctctgaaaagccttaaggaacatgctcctggcaaagcctctagaacaattccaagaatggcactgctggtgcaggctggggaggagctcctgctgcctgagactccacattcaagctgtctcctgcagaaaacagagcagctcttctcactactgcccccagaaggacagccgctctgctattgactactagaaaactgacccctttctctgcagacctgcctgtgctgattacatcttcatgtcagtctcacatagattcatctgttttcaaggctacagggtttatttctgcccaagtccatcctgtggctttctatcataaatgcacatctttgtacacttgaatttccaggcattactagtatcaaccacaacaggctacaatctaaaataaatattttctttacaaagaacatcatgctccccacgtagcattgtgctccccaaaatgtggggaatctccaatctgttcagcccaacaccttccaggaaaaaatgatcttctctcatgagccattaatctgtgtacatattatttaatatgtggtctatattataaaggtggctaaaaatagcactttgatttttttaaagaaagggtgtattgaaaagactaaattatttaacatacatatatgaatggctcatttcgttattgtcaccagcttcttctgtatttattttattctctagtttctggcaataatttctctatggtagagtctggaaaggctattcctcatgtccttggcttcctaagtcccataggtggtgaagaatgcccatcagatgtgttactacagagtgcttttggattgagatgagggaggggaagtgcctgatctcactcaaatgtactcaatttcctggtctgggtcacagccaggcagcacagtcttgtgggcacagtatcttcacttgccatgtttctatcaaaatgagagtatcttccttcactgtggaaaacaaggggtgggcagggtgagggaatagcaaagggagtacttggagatccctaagctgccactggtttctccaaatgttttcaatccatttaattcatgataataaacacctttctacctaaccagtcataatcgcttttctcagatccaactgattcagtgataaatctaaagagaaaaaataaatacacttttccacgtttaagctgaccaggaatgtttccacctccatatcccactatgcgtttcatcttccctttgcctcactggcgatccaagtgcaagtaatgcttcacatgactgtgatccctagaacttctacctgatgactgttgacgtcttctctgagttttaccagtggaaatggcaataaatagaaacattccagaaggtcccctagggtgcatattttctgtacttcctctctaagatatgtaaaatcaattctatttgctcttgctttatatgaactagacctatggccccagcaaacaaactaacaccctgtgttgacaacttatccagtattgtattaagtctaaatgttcacatgcttatatcatttcttacaatttcttgggataattgtcatgtcaactctttggattaagaatcatcaaccaggccaggcgtggtggctcatgcctgtaatcccagcactttgggaggcagaggcaggcagatcacgaggtcaagagatcaagaccttcctggcccacatgttgaaaccccgtttgtagtaaaaatacaaaaattagctgggctacaggtggtgtaccccctgtagtcccagctactcgggaggctgaggcaggagaatagcttaaacctgggaggcagaggttacggtgaagccgagatggcgccattgcactccagcctggcagcagagtgagagtccgtcttaaaaaaaaaaaagaaccatcaaccagaaaaccacagccctgagaaaacagaaatagagtatttcaagctgttcagttggcgttaacaatggtaagtctacagctcattttcaagatatatatattctgtttaagggagtaaaagcacccatcacagttaatgtttcagagcctccaccacttctgatggtatagtaattcaacagcacaagggtttgtgtgacagctttgcttgactaataatgggtttttccctgtctatagggaaagttgcacctgtgcacaagacaagatcataagctacacttcgctcttcttttttgaggtaaataacttgcttgatccaaagccattttatggaagaatttcctgattctgatgaaagcacttggaaaatcctcaaataatattttatgcagaaacataaccgataataatggcaaattcatatataggaaaataaccagtgctttccttatgttacatgaggtccactagtatcacctaatacaagctgttagtctgagccctgatgtatcatacaatgttaggggttcttcttgacaaattagatgttcagaaaagccggtagccctgtaggtctcagttagttgaaagtcatattattgagtccccacagggacctccataacattggttcatgatactccctggggaagctgggaaagctgactgactgaagtccatgtgttgaatcatcctcattattaaaagccccctgctcattaatggcattttgattaatactcacttggaaaacatttttttggattgtggctcatttttgaaacatctcatcatagctcttccagaatggctttgtctgcaatcatcctgttgtgtttcttttaaggcctgatgatctgtcaaaaccaacagccaatattattaaaatcctcttctctttgcaatgggatcatcagatgtaaccttacagattacccacggttaggatttttacatttccagggcttccttgacaatggcactgatgtgactccatccagcatccattgttgtgaggactctatttggcatatcatcattgtgggcatgaacttaatggagattttcataggatgcaatggttaatattcaacgttagtcaaaatttcttctagtcctacccttggagctctactgggttggaaaaatattttcgtgtaaggacaaccatttggtagagttttaaaaataaaggctaccaataaattttctgtagcaagagtatgaactatttgtggtccagaatacaattttttatggaatgtaacaaaaattatttaaatgtattcaatgtagataataattttacaaataggcttatattgcatatataatagaagaaacacaattaaacataaatactatatatattgtagccattttaacaaatatatatttacttgtacatatcttacatacatttatgcacatttttccacaaataaggtaaattttaattttttattgaaatattagttttaattttgtcattaattttcttttaataactttataatttgattactaaatattcacatttataccaccaatttaagaaaaaatacatgtgtgtatatataggtagaggtgtaaatactgtatcaggaagcttttatgcattaatgattggtaactggctaaatacacaactcagtgacagaaaacagtaaacatgttttcatgttcatgggtgctcatgttcacaatcatctggccgatcaaggaagggctcaggtaagtggtttctctgcatggcactgagctggtcttcagcctatacatattaattgtctcaggacaaggctgaacggcagtgactacccatgactcaagattcttctggcaggtcacaagagtgaacaacatcccaaaccaaactgcacagttgagtttaagtccaataatttctaacatagcttcacacattttaaatatattcctttatttcagtgagtacaaatttttaagaaaatgttcactccacttaattatagaggtgtttgatcatccatggacaaataactatgattccaacttacagtattgaaaatatttgcaaatgtaaatttgcattaataagaaactgaagctggatgtgttttcaacacgtggctttaaatataatatacttaaatggcctcatgggagaaaattcattttaacttacataaatatccctttttgcctctcttttgtcccatagagttgcccaataagaggtccttccatgagatttggaagtcagaaaaggatgactcaatattctccattggtacctaagacgtctagacacagggacagggatgaggactggagaaacacctggaaagatgctgtaggaagctgagagcatcagcacccccgcccctaagcttccagacaggactgagggccacatggttagatagcccatactttaggggcagatggattctgttttctgaggaagcaccagagaatcctgcttctattatcagctttcgtgactactatatccttggctttgaaaggttgcagtgtgaacgttaattgtaggaattgggtcattcttgacatacccaacagagccaagaaaccagtggggaaagacactcagggtgtaaaatattgtctgaagaatgcaattgaaataggccctattatcccatggaagtaatgtttatggttttttgaataaacatagaaattgacttccccagtcttaaaactcaagatagttacatttgtcttatctgagttcttttttcaggaaagccaccaagaggcctccagatactatcagagagctgaaacttacatatcactgaatcaggacagtgagacgtcagacccttcacacactgtgattgcctcactgaccttctgctccctgttgacaaaattaacttcattacccctctctaattcctgtttgcccacatttcttccctgctatataaccccctaattttagtttgtcagggagatacatttgagaatggggtcccatttcctcagctgcagcacctgattaaagcctgtttcttggcaatacttgttgtcttactgattggttttatatgtggtgagcagcaggatctacaccaaatccctcgcacttcagtaacaagattctctgcaagcttcactgctttggcctcttgtaacctgaaatcaaattcacctccaacttctgaataatttaacataattctaggattcagtttgtccatcagtgcttaccattctgagcttgccagctcccaaaactttctggagccaataaactttctcaaagagcaataggtaacattttccttttttcatgaaactctaagcttctctttgttctttcaacatattgaagaccattgagtttttctgtatgccccatttagcaaatatttcttagcaaataaaacatgaaatttgagattcatctctatatttttatttagacttccatggtttatactctatttctctgtatcaagacaattcctgcttagaatatctatagtggcttcttctctgttacttgaattccaagtgaagccataaactagactcctcaggtgtcatgatccctgccttttttaaatcaggagaggaactgttatgtctgtgcacctggtgctaagaaagaaaaagaaattgggatgcagaggtgacttcacatccccctctaccaacaccatcagagtgtggctgcatctgaggaacactcttagccgatggagacatcaggaggagcagctggggcagcccagcctcacacatctctttccctgggggtttttgtttgggtgtgtaacactgtgggaggggtactataatactgttgacagtaataagttgcaaaatcttcaggctgcaggctgctgatggtgagagtgtaatccgtcccagatccactgccgctgaaccttgatgggaccccactttgcaaactggatgcataatagatgaagagcttaggggcttttgctggtttttgctgataccaggctaaataactgctaatgccctgactggcccagcaagtgatggtgactctgtctcctacagatgcagacagggagaatggagactgggtcatccggatggcacatctggcacctgagattggaaatataaacacaaatgtccatacaattaatcatgttgtaagagaacttccctcaagagccaggctgtacggaacacactgggctgagtaaactgctagggttctccttccttacctgggaaccagagcagcaggagccccaggcgctgagcgggcaccctcatgtccatgctgtgtcctgactgggtctgactcctgcatgaagtgtgaccagcgcattaataagtcttcagggtaggaggatgtgctctgggaacatgcaaattagcagggggcaaggcaggctgggcacagctgcagggctggttcatctcagtaactcagcaccagctcagtgtccccaggtgtcccagaaaagaccagggtagcacaaatttgtctgcagtgatgtgttctactttggactattttgttatgagaagtattttttaggtattttttgacaatttgaaatattcctcaggagtcgaaggagtaatgtgtttcattggtgtatggggattatttaggagaatattcttgtttgtaggaaatacatagtaaaatgttaaacggtactattctcaggtcttcaaaggactctcacatgattccggttaggcaagggggtactttgtgctacatttgcaacattactgtgagtttaacattgtttctttctaaaaaaaaattaaaaataaaatttattgacatgatgctatatatatttgtaagtattaggtaatggtattatgccattgttcttaccactataagatcaagcaatttactacagatacacagagatgataccgtgtttcctcaatgcatgcagcactcacacatccaccattatcaagagctacaggtctttttaataccagagactaaatgcgctgcaccgtattcttgttttgggcaccttcatagtctaccttcttttctgtcattgagtatcttttcctaaagtttatctctcttagtgaggtcggccactgcacagagcatgtccctgccatgcaccatcaatgacactttcctcttttacattttatcagtgactggggacatcatcatgacccagacaccagcctgcttgttaccatttttaggaaagagacagtcaatctcttatcaagcaatttcccatgtacatggagaaatcagttggatccagatgaaactggacacgattttcactcgttatatctcacatctctaatgtgccaaaaatgtcccagcctggctcagtagcaggggaagtggatccaactacatcagcatcagtgggctacagtctagggctccacaaaattttactgatgcctgactaggggagcaaaatcacagtgctgtagcccatgcacaaaccttcctgctgctttgcaagcgatctgaattttaagggaacttgcttatattgggagaaaggaagaaagttccatttatcctctaaatgtttgctgaaaataaactgacaaaagaaagattaataagagaaaaggcaaacaaaattcacttaaagtgcagtggaatatcacagcagggtgattacccagataactcaatgagattcaggtgtttatatttcctttctatagaattgggaagtgtaggcaacctagagaaaatagatgagaatagaagtgcatcctcaaaagaacaggtaacagcctgcctggataaagtatcaacttccagtctcttctatttttaattcctgttttgtgttaatcttccttgatatacaaattctcaggaagaatcttcttgacaattggtttccttctggtgaatctgcttttagtcagataagggatatttaggagaagcctttttgtgcatttgctgctttctcaatgcctttggttttatataatcatcataccaatgcagcatactttgggatattattttctggattcttttacttgcaacccacatgccaaaatcctgttccagagagatgcagctacagattgaaagagcagttgacccctgaacaacgtggaggttggggcactgaccactggtgcagttgaaaacctgtgtagaacttttgctttcctaactaagaactaatagcttacttttgactggaagacccagtgataaaataaacagttgattaacagtttttaaaagttatttatattatatactctattcttccaataaagtatgctaaagaaaaaatgttattgagaaaaccataaaaattagaaaatatgtttacaacttactaagagcttgctcacaggtgacacacatagaagaaaatataggtgggtctgcaaatttcaaacctaatttattcaagggttaactgtaccatgatgaatgtagcagtccccatctgtagtgtagggctttcccctttgctgtacctctgctcacttccaatgaccatatatatgtcttatgtcctttacagtcttgggcaaagagctctgccttcatgcattgctggccaaatggcctggaatgtgtatctcttatgaaactgttatggtttgactgtgtcctctagaatcaatctgttgtgaagttaattctcagtgtaacggtattgccaggtggggcctattggggtgtgtttaggtcatgggtgtggtgccctctagtggaatacattaatgccaatataaacagggattatgggactgggatctctctctctctctcttctgcttgtctgtcatgataagagatggccttcctggctttgaaggactcaaccctccaggcatcatcttgaaagcagagaaagcagaccttatcctgcctatgccttgatcttaaatttcctattctccagaagtgtgaggaaatacatttctgttatttatgaattacacagtgacaaggaatctgttatagcagcttgaaagagaacaagagagacagctcacaatcagtgaggacacgatgaggtgtatacataccccagcttcctcatctctcaggtggaatagcccagaggaatttaatctatgttttcacatgtggttgaccttcagttatcctgagtcaggtgggttgttgatgtgtcttttaccattcatcttctgttccctccctcactttcctcctttcctcccagtgtaaatttgctgcctaaacaggaatcctcattgctggtggacccaaactaagacagtttaaaaaaaaaatcattattcttttgtatgaggggtatttctcatctgaattcttatcatttcattttctttgacatttggaatattcaggaagcacttaatttttctttaccaatttattttagattggatttatgccatgattttttttttctgtgtgttaaaaccaaaaattaagttgtaggccaccaaccaggtgaatggactcctcttttggcagagagaacttcaaagaaatctgaaaaactaggttaggccatgactggcaggtaggtttagatgtgcctcattatgctcttctccctttggagttcagacacaactgaccagcattatcactactacagagatctttggactgacaaaacagatgctttatagcaataagataccatactccaacatgacagataatagcccctaaagaaaatctaaatattttatcctaaaattatttctttgacatattctgcagtggccctgcaaagctgcctgttgtggggggaaatttgcattctgcagagaaactcctcccattactatgtcttttccaaagagtctgactttttttaaaggtctgataagcaacattcaccatctactttatctgctacccacaggattcatctatgtgacaagaatcttggcttccacaccccattatctaaactcaagcatttctttatgatgaattcaactccttaggcagactttaactctttcaactagtggcccatcaggaaagctttgaatccacctatgacctggaagcccctgcttcaagatatcccacctttccaagacaaacttatgtatatctgatatgtattgatttatgtctttgcctgaatttctgtgtctccctaaggcgtataaaaccaatgtgtaatccaaccaccttgggcacgtgtttgcggagcctcctaatgttgtgtcacaggccataagccttatctttggcaaaataaatctataacttgattgagacctttctcagatactgttttgtttacactgggtcacaaaatttaaaaatcctctaaaattatctacacatcaataaatctacattagcaacagtggagtgagcacactccaacagataaaactcacaagttacaggaacctgagtctaagattttgtccacctctcttgattcataaaaatactttgtgattttttaaattttactttagagaaggacaattttggggaatatgtttattgttggtgggatgaataatgtccccaccccgagagatgtccatgtcctcatctctggaacccaagtgttataggagttattaagaaattattgtaggcagatagagaggaaaaggggtgcttgtgaaggttttgttatgtttaaagcagctctagaaagatttcttgtctagcaggaaaacactggctcttagatccaggctggcaagctttcatatgtaaatgcccgccattagaaactgggttcacccaaacatggtgattcccaccatcttcttccttgtccccacataggcctggcaacatggctgtccctatatatccccatgtgtgtagaacattatggtgccctgcaattgcatattaaaaggctagggtgggagggccagttttttctgcaggctacctgaatgacatgcctggtcataccaatcccctgagccctatgcaaatcagacaccaccttctccagcctccttatataaggagccacttttccgcagcacatggggttttccctttgttcgaatcccctgtccctctgtctctgtatggggaagctattttcatcttccttcgtacttgtgtattaaacttttctctccttaaaaccactccactcatgtttgtgtcattttatccaaactggcgtgagaccaagaaccctggtgttcctccagtcatcggagccttatcataaggattcttccttacatagtgaaaaaagaacttgacagatggaagttaaggactttgagaataagcaacctggttatccagattaaataaataaaacccccaaggtccttaaaatagaggaggaggcttgcagtcagagaggagctgggacaatggggaaggatgtggtttgaagaaggaaggggccatggaaccagaaatgtgggagcacctggaagataagaagcagaggatccagttctctcctctggagcctctagaagaattacagccctactgacaccttaacattagctcagtgagacttctgacccccagaactacagggtaatacacttatgttgtgtgaagccaataagaccgtggcgatttaaacagcagcgttggaaactaatgcatgaggaagagatgtctttcacctcaccaagtgcatgcttgtcctctgttcttggaaatatttttaccttgtcttctggtgtcaattatgacacatcttctagtatttaaagatctgctaccctaaaattctatttccagtaaaagtattatttagaaatgaaggtcaaattgagaagtcctcagctgtagaaaaactaagagtattggctgctagcagatccactttaagcatagccaaaatgattcctaggaaggtaaaactaaagatcaagaggggatattaaataatttagggacaaaaggctatgaaaatgagaagagagatgaatataatgcatttctaaatcatatgtgatatttgtatcaaagttgtaacacagttttgttcccaatatttgcagagaaattacttttaaaaaaccacctatttacaatgggggaggaaaaatgatataaaagaaggtaaaagtctatatttattttaaatggtaatatattgacaccaatgtactatgagaagctgtgcatataaaggcaatataccatgacaaccaatttaaaaatcactataaaaagagataccccaaaattaggtaaaattaaaatgaaattgtaaaaatgttcaagtaacccaaaggaaggcagcaaaaagaaaacagagaagcaaaaaaagatacagcaaaaaagtagagtgcagacttaaatcttaatatatcaataattactgatatattaaatacgtaaattatgaaatttttaaaaagacaacggttggtgaatcaaaaagaaatgttccaactgtatattgtctataagacactcacatcaaatacagcaatataagtagattgaatataataggaaggaaaatggtatactatgcaaacattaatcaaaagaaagaatcattagcaaatactattaacagacaaagtagactatagagccaaagaattttaccagggatagaaagttacattacataatgaagaaagtcattttggaaagaagacagagcagttctaagtgcgtagacaccaagcaacagagcaatacagtgcatgtggcagaaactaacagaacaattacacttggagatttcaaaaccccttcttaatctttgataggacaactcgacagaaaatcggccaggatagagaagaactcaacaatatcatcaacccatgggatctaactggcatttatagaacactccaacccataacaatagaagttcacatttctttcttccaagtgcccacagaacatataccaagataggacatattctgcccacataacgtttcaacacaattgcaataattaaaatcacagtaagtgtgttctctgaccacggaaggatcaaactagaaatcaatattgaaagtataaccccgaattcttcaaatatatggaacttatacaacactgttctttccaaagaatcagcctttgatttgcttggtgtttagtgttgctttttctgtttgcagttttattggtttctgccctaatatttattatatattttgctcacgttctacttcagatttaaattgctcctctttatgtagtttcataaggtgggagctgtgattattgattttatgccttttattttttgaaaaacacttctatgcatatgttaatatatgtgcatacacacgcataaatatgtgcaggtgcatatgcatacatgtggctttattacataaattaccctgtaagcgctgctgaatacctatgtgtattttctttcctctgagctcaaactccactcacttgcaaacctggccacttaatctgcatgtttattagcatctcaatctagaattgaacaaaaataacaaactccttttattttatcctgattttcttggctgctaatacatttaacatcagtaaatcagaatctatctaatagattaagtccaaagctgccaggccactcctaatctgactcttctcacataaaggagtataaatgacattaatttaaaaatatgatatcatctgcttatgtctccaataatcttcactgcccccagactagtttatgccagggttcactttgcccagatgagtatctcttctccttctcacagcccaactggagtcattactctgctaaaaaataaatatgaccatgggagtactttgctttaaaaaattcacagaatgtcctgctgtacttagaaagcatttgctcctcaaacagaaaatgaaggcgtccttcatttcacatccgtcatatgtggtgatctttaagatactgggagaaaacagctctgacctgccccctctcagactttctcttttttcacttggttaagtcactctcctcatagtgactttctatgtccttcccgtgttcatactgtgttcctcctaagagccttgattgtcatgaacctcgatgcccttcagaaacttctcttcaggtcagttcttctcctcatccaggccagtcacctcctcagaggaagcagcctctgcctccccaactaactgactccatttccttattaaccacttcctcttcccttgccatttttttttcctttatgatccttatccttttctagaatcttcctgttgatttatgtttaattaaacatggccttttttttttcaccagaaaagatataggtaaatgagagtcagacactgactttctcagggatgcagcctacacacattcctggtccagcataattgctcaatttatactttactgaatgaatgaatgaatgaaaatttaatgagtaagaaactctcaaagacataatcaacactcataacctatacacattgaaaacaacccactgaatgtacaacatggattattctgagtaatgagaagtatgaacagcagtgtgctgctcttcatagtcagaaagaatgagaggaaattgaagaaaggaattgttttctcagctgcattttgcatttgccagagagttaagaaagacatccaaagtccatgataatcaggtatgaggattcttatctgccttaaaaaacaagcaaataggctttgcaatcacaaaaaaaaatgcaataaatgtgactaccctatcacttaactctattgcctcctgttcacaaaaacagattgtattagttagctcttcttgcaaaacaaaccagctccaaacacaatgccataaaatgagcatgtacagtcttccctcagtatgcatgggaaataggttccaggacaccctgcagacattccaatttttggagactcaaaacctttatgtaaaataagcaatatttgtatataacatacacatatcctcctgtacacttcacaccacctctagcctacttataatactaatacatgacttaacttgtgtggattcattcaagtggtactcagcacatggcaaagtcaagttttgctttttggaattttgtggatgttttttctaaatatttttgatccaggtttagttgaatccatagatgcagatcccatggacagagggctgactgtattgctccttataattctgagggtcagctctgcggttcttccatattgggctggctgtagcctctggttcagttgtgactggagggtctgatgtgacttctttaacttatctagaagctggttcgatgtacaggttggacaacacttggtatcagtttacatgggtcagggagatgggtcctgttctccaacctctattaggtttgttcccagatcaactcgggggttcaagtctattcattgtgggttgtttgggagaaattccacacagaccgttggtaatgactaagctgaactgctgtcatttattgctgtcagcagttattgttatcctctgaaatgcatcttatataatcaaggtctccccagggtggctgaacagtgcatctcagctcagcccatccagtcacttccctggatgcctgcaggtgtgagaaaggcaatatgctcagtcacaggaaaggcaggggcccaccctcgtgctgaaacctgcatacacagctttcacacagtttcgttccaaaatacaaaaacttcattttctttatacttaaaatagttatacaatttctttctataatgtccccatgtttttttaaataatttgaatgttcagaactggatatatttattatttctgtgttaggtgatcttagtcacttatggcaagagtgagttaatagagacaagatacggattagccatggaacaatacagaagtgtgtggattcagataggataaagctcaaaggggtgacaagtaaattcttttgcagaaacagattctcatagatcaccactagttaaggtccacattcaaggtgcgatgatgcgtcagccacattttgtaaatggtcagctctgcagagtaaacttggccagcacattgcaggaccaaaactaccgataaaggtatggggaagataaaccatcacagaaataatagtttgaaggagttctcagttatttatacttggatgttcagcagaacgctacaatgaatgaagctacaacctaaaaattttaaaccttttaaagaggtttcccttttttcagggtgtttctcagcaaataatcacaaaaaatttgtggataaactacttgaacaattggctgcaataaatcccttccctgtactcatcctttggttggcatcattctaaatggactctggtgttgcccatgtgtcttgctctagctaataggataatagcagatttgacacaagtggagtcttggaaagggcttgcacatcgaaactttcctctctctcgcagtgcctggaaaccctaaggtcacaatgagaataagcctgtgcccatctgcagtcaatgtcagtgacatggctgctcttaggtctactattttttcttaaaatgtgtgttaagtttgttgtggccaggtaacaaattaccacaaatttatcagcttaagaccacacccatttatcatctcttaatttctgagtcagcagtcggcacatggctttgttgggtcctgcccactggatttcacaagactgtgccacagtgtagactgggcttcattctcacctgagactcccctgagaacacagatactttagagctctttcaggtagttgcagagctcattccttaacacctctatttcttaaggcttcaatttctaactggctcttggttcaaggctgctctcaggtcctagaggctgtggacaattccctgccatgtgatgcttacacaggcaatgcccacatggctgtttgcttgttcaaggccagcagaaggtttcagagagtgtctctttccagtctgctatgacagaggcttatagaatacaatacaatgattggaaagacatctcacaacctctgccataccgtatgggttagaagcaagtctaggttctgcctgttctctgtggaggtagattatacagttctgtgactcactggggagagggttctgctagggtgttctggcatctttagtttagtcaaatatcaggtacttgtactgagtgtgaaatctatcctgcatctactggcagtgactagtcctgtcacccctgggaacatctggggaggcatactttataagagatgttttaggataacccagctcctgttggtgaagtataacatttgcaaaatatcctaatttttgtgatttctaacatgtcttcaaggttacttaattgtaatgatcataagccaattatctctaaatatcctcgaaatttatatttaatagtggaaaaatgaattattaaggagtctgctaaataagactcagggaaataatgtcaatacccaattgctgccgcccactgctagactatgtgagaatattttcatgaacaatagaacagatactgcatgctagacactgctgtgagcaccactggcctgccacctctagaaacgtttgcagaatgagggcaattgttatgagtctccaaatataaatataatatggaattgttttgtttgttaaataaaactttaattatttctatcattatataacatcaaacttgattctgtcttggatccaaatattattagagcattcctttaaatgtggcatatataaagcatatggttctatatatttattactggaatataaaaatcagttagtatcaagcattgcaagctctgactatcatttgttcagtttttacccttcactttccaaataggtgtgatcatgtcttgtgcatttattcatattcatttgatacacattgttatgttcttgatatgcatttttcttatatcacaaagttggcattcctttttttatttattattattatactttaagttctagggtacatgtgcagaagatgcaggtttgttacataggtatacgtgggctatggtggcttgctgcacccatcaacctgtcatctaggttttaagccccacatgcattaggtatttgtcctaatactctccctttctttgcctccctcctcctgacaggccccggtgtgtgatgttcccctccctgtgtccatgtattctcattgttcaactcccatttatgagtgagaacatgcagtgtttggttttctgttcctgtgttagtttgctgagaatgatggtttccagcttcatccatgtccctgaaaagaacatgaactcattcttttctatggctgcatagtattccatggtatatatgtgccacattttctttatccagtctatcactgatcactttcccactttctgatgtgggcatttagtgctataaatttctctcttaacactgctttagctgtgtcccagagattctgatacattatgtctttgttctcattggtttcaaagaacttatttatttctgccttaatttcattatttatcaagtagtcattcaggagagggttgttcagtttccatgtagtggtgcggttttgagtgagtttcttaatcctgagttctgatttgattgcactgtggtctgagagactgttatgattgttatttttttgcatttactgaggagtgttttacttccaattatgtggtcaattttagaataagggctatgtggtgctgagaagaatgtatattctgttgatttagggtgaagagttctgtgtatatgtattaggtccacttagtccagagctgagttcaagtcctgaatatcattgttaattttctgtctcattgatctgtctaattttgacagtggggtgttaaagtcttccactattattgtgtggaggtctaagtctctttgtacatctctaagagcttgctttttgaatctgggtgcccctgtgttgggggcatatatatttgggatagttagttcttcttgctgcattgatacctttaccattaagtaaaattcttctttgtttttttatttttgttggtttaaagtctgttttatcagagactagggttgcaacccttgcttttttttctttcagtctccttggtaagtattcctccatccctttattttgagcctatgtatgtctttgcatgtgagatgggtctcctgaatatagcacaccaataggtcttgactctttatccagtttgccagtctgtgtcttttaattggggcacttagcccatttacatttatggttaatattgttatgtgtggatttgatcctgtcatcatgatggtagttgattattttgcacattagttgatacagttttttcatagtgtcattggtctttttggtatgcttttgcagtggctggtaccggtttttcctttccatatttagcacttccatcaggagctcttgtaaggcaggcctggtggtaacaaaatagctcagcatttgcttgtctgtaaagaattttatttcttcttcacttatgaaggtttgtttgtctggatatgaaattctggtgcctcccaaatcatcattttttctcatatcatccccagatatatgatatgggaaaatcaacatttggaaactcatctgtgtccttctgggttgactaggaaggtgtgacatgatttcacagtaatttccctaacccttgagtcactaaagtcctaaagccctgtgtgatgcacaagttaccccatgagcttgcagcgacatcagggcatagccttgaagttcaggcaggagtctattcaacacttgattctttctaagagatacttattagtttctatctgggtttgtagctaaacccaaaccccactgtcataggaaccccaacaaacacgagcaacagagcttggtttgcaccaaaagctgacatctgctttcactgcttgctttcactgctgctgccccaaatcctactattctcatttctattaggcaaaaagttgccttatattatcttatatttttcaaaattctattgaatatggcatacaaatgtatactttctaaatgcttccagacttgtttcttcatttttaaaactcagattgagaattcagaaatctctccttttacttcatcttgctgtgtctgactgatcagacatttcacacaggacttttgtttttaagtagatttaacaacatctatttagtagctgaaagctgagaatgtcaacatttttacctggctactctctgcaacagtggtataaaaaggggtcattccaccccctttcctggagagagacaggtgcaaagaaaaagtggaagtgtgaagctgggaaaagaaagagaaacagtctttatacacctaaactaacccaggtacatgtacaccaggaactatttaatcaaaataaaatccagaaaaggtgttagttttggtttggcatgaaccagtcttaaatataaagttgttatactgaataggttcaattgaccaaaaaatgtagggaaggcaggaaggattaggatgtgctttcactcagctttatctgctgtcacgtctggttactcaggggggcacttggatcccctccattgtcctgctggttctgccaggccaaggctgttaaatctggtggagtctcatgtgtggacttttgggtatatacagggagaacatcagagaaaggcctaccagactttactggatattgttaatctgacatgggcttttggagaaaaaaaggctttagatgaaaagtgttggacaaagtcacgcatggcttatctaaaaaacaaaaaatcaaatacaacttgaaaactcttgctagagaaaatagatgactttagaaaaaggtgaagtgacatttcagtttcccaaatcactcttcttcatacatgttcacttagctttttttcaccttctatctctgaggttttagaagggcctgagctaaaaggaatttgtttccataggaatccagcaagtaaaacataaacaacatcaaataatctacatcattatcatagaagcatgtcaaagaaactaagattaggttgtgagttatggcacaagtattagagaaatagagaaaagatttaaaagatagaataagacttacacaagaaagcaggacagccttatgacaattgaacatatcataggataataggttgtgataatggatggtgagaagaaatggattggacagataggcatgggcgtgattgaagatctgagcaatttagcatagatcaagacagaatccttgggatttaaagtgttgtcaattggatagtggaaaaatctggggatgtaatgaacttggatttaacactatttccaataagtttctgctaagttaggccagttatgataatgatgactattacagtgctaagtattatagcaataagtatactgaaattaatagcagcatatattatctgttggataatattctaaatgttttacattgtttaaatagtaaacagacctgtgaggtagaacctactattgtcacagcaacgcaggtatagaaactgaggtaaagggaggttaagtcactttactaatgtcacacagtctgtaagcagtaagctctgtccccacccccaagggtttgacttcagggcctgccaagacaacgtctggactgttgcatggatcttgcctggctgtacatgaagctctaattccagaatggatgaagatgccggtagaacttggtgtagcattaataaaattgtttccttcagaccaagagaaatgtccagagggcaaaagagtttaactgcttaaaggaaagaagcagatttataggaaatgaagttctggagtgtgaacagagtttttcacaaccattaaggagaagagaaattgagtctagtttgatagatgtgctgtgtagaatgagtggtgtggagattagagaatcagccaaggaattgtcccctgccttcctggatcgcatcatcatctgtcttcaaggcaattgtatcggtaccctgagggtcagagcctgggtcctgcttatccatgcagctgtggtcacctttgcacctgcagtgctggagttaattgagtgttactttttgaggcagcttcaggacccttggtaaaaatcactaagcatcaagcaaaaggcatttttggaagaaaattctaatcagctcttcattcccacctgatgcaatttttgctgctgctgggaccccaagttcttgatcccaattttgttttttcttttatttatttatttatttatttatttatttatttatttatttatttatttattttgagatagagttttgctcctgttgcccaggctggagtgcagtggtgaggtctcagctcactgcaaccttcacttcctgggttcaagtgattctgctacctcagcctcctgagtagctgggattgcaggtgctcaccaccacgtccagctaattttgcatatttagtagagacaggctttcaccatgttcgtcaggctgatttcgaactcctgacatcaggtgacccaccgcctcagtctcccaaagtgcagggactacaggagtgagccattgcacctggccccttgccccttttgtaaatagaaattaacaccagaccacaacagaaattttctcaggcaaggtttaataggtttgtggcatgagcaaagcaagggagcagcctatgggtaagagatcccagtggcaatgccctgaagtgcccagctcttaccattttaaggaagctgagggggaaaaggaatgacatacaagcatgtttaggcaaagttttctttgcatttgtgcagtggagcgtcatgctctaacatatataacatgatcaggaaatggagaataagctctgcctttggtggatattttagtattacaatgagattataatgaggaaaaatcagtgaaaggtcagtgctggagaccatctcgtcttcagccagctagatctcatttggttctttggagcaatgccagatcttgcagcaatcttgcaagatgaccaggttcttatcaggaacgttagagttccactttagaaaccttgagaggccaggggcagtagctcacacctgtaatcccagcaatttgggaggccaaggaggatggattgcttgaggttaggagtttgagaccagcctggccaacatggtgatacaccatctttactaaatatacaaaaaatagccaggcatggtggtgtgtgcctgaagtcctagctactcaggaggttgaggtaggagaatcacttgaacctgggaggcagaggctgcagtgagcggacattgtgccattgcatcccatcgtgggtgacagagtgagactctgtctcaagaaaaaaataaaataaaaccttgagagacatcaccaaaggagataaatggttgagctcttctttttatggataggattttggcctagtccactaagttgggagaggacagctttttggtatggaactggaatcagctatgttaagggaggcaagaaggttggagtggaaacattcctggacatgtgaggcccattgggatcctgagaacaatgtctttttcctgccacaactgtatctcttccttatactctcacaatcatgcaccaagagagacaactaggcacattttgggtagaaagagagagatggggccacagttttctattttgttcctaacagtccttttccaaacaccatctcagtgactccagatgactggcgagacaggagaacacaggcattaaattctgtgaccaaggacagaaattctaaactcaggctgagctaacagccttttctgacctgatcacctgggcaaaacctgaccaatataatatttacatttctaaccatacagatagattcattttataaaaattgatggtatagatatgaatagttggtaatccatttagaaaaatattaagaagaaactgaaactaaataatatttgtgtataatgatggtaatttgtgtcattaaaaaaatgtacatatggtatataaccactcaaaactcggtggctaataacactaagcatttattttcctgttcatgataacaatcatctggttgatcaaggaagggcttagaagggtggttctgctgcaaggcactgagattatcaccagcacttgaatagggtttgatctgggacccaggcagggtctaaccaaggtacaacatgcctgtggcaagcagcaggagtgaatacaatccccaaaccaaactgaataggaaaataatttaaatccaattattggacttacattatttgccttttcagcttaagtctaataattattataaggacaataatctctaacccaggtacacacagttttaattttgttctttccctttggtaaatactaaagtttctaaaaacatttactgcatttaattatcaaggtatttgatctattgataaaaaataattttttttaacttttacaatcttaaaaatgcctttgaaagaaattttgcactaattagaattaaagctgagtgtgcctttaacatgtggttttaatataaatggcctctgtaaaaaatatacattttgagctgaggtaaaatcctctagaacatagctcctgaaaatttcagtagattacccctacacttgttaaaatgcagattgtaacacaataggtacaagatgcatttgttagtttgcattcataacatgctcattgtgatgctgaggaggcagttgagttggcagctggacaaattttgattagcaaagtgttttcacattaaggaaaaaatatactttgtgaacaattaggtgtcttggttgttttatcaagaaagtgtttcatttttttgtcaaagaattgctaggtattctaaacaattttctcctttttctgtttactttatgacacaggaagttttcttgcaataatcccaaacttgctaataagacgtggaagcacatgcaaggatattcttcggtcatcccaaatctggaaaattctgagatttggggaaatattgaccttaattggttgtcagctctccattcctcattatcaccatcatttctggaaacacatttcacaaaaacccttttcccactatggtttcttgtagagttgctcaataatgggccctcatgtcatacgtaagagtcagaggaggatgattcaatattcattgacacctgcaggtagacacatggactgaggtgaggactggagaatcaccgagtgacgtgctacaggcagctaagagaatcagcaccctaacatctctacttcctagacagggcagaggaccacatgtttaagcagcccatacattcagggtcagatgcgttcaggcttctggtggaccaccagagagtcccgtatttctagtatcagcttctctgtttaccacacccccaggtatggatgtttgactctaattccctgttttaaaacaattccttcttgaaatctgtagagtggtttctattttgatgtatgaaccctgactgatgcaacaacacagattcctcaggtatcataattgctatcattactaaatcagggagacgttgtcatgtctgtgctcctgggactgaggatgaagaaagagagttagaaaacaggggagactccctgatcccttgtgccaaaagcttaaaaacttgtatacatctgagaaatgctttcagcagatggaggcaccaggcggagcctctgtgcaacccaacttcatacatttgtttcactaaggggcttatgttcaggcttgtaaccctgtgggagggtaactgaagtcctgtttacagtaataagctgcaaaatcttcaggcttcaggctgatgatggtgagagtgaaatccgtcccagatcccctgccactgaacctcgatgagaccccagggtgcaaatcttttgcatcatagaggaagagcttaggggatttccctggtttctgcagataccaggctaaattactgctaatgccctcacttgcccagcaaatgatactgactctgtctcctacagatgcagacaggaaagatggagactggatcatctggatgtcaaatctgacacctgagattggaaacataaaaacaaatatccacaccatgaatcatggtataagagaacttcccagaagtgccagagcacagtgggctaagaaaattcctagtgttctccttccttacctgggagccagagcagcaggagccccaggagctgagcggggaccctcatgtccatgctgtgtcctgactgggactgactcctgcacaggtgtgaccagcctattaagaagtctttagggcagggggtggtgctctgggaacaagcaaaacggcagggggtggggcaggctggatacagctgcgtggctggctcatctcagtaactcagcacaggggcagtgtccccagtgtcccaggtcagaccagggcacctagatttgcctgcagagaatgtttcttcctaaaggatattttgttaccaagtacatttttgagcatttattggcaaaactcgaagtggttgtgagaactagatggaataatatatttcaatgctgtattgggaataagtaggagaatatccttgtttgtagagagtgcttaataaagtcttagagagtggggctatcaggtcttcaacacactgtgaaattgttccagttgggagcgatactttgtgacatacatactacatttttgtaagcatgaaattgatctttttttaagtaaaaaagaacacttagtcatgagcaagtaaaatgttctcaaaagcattttgtaatggccctaaaccaatgttattaccagtctaagctgaagaggtttactgcagattgacaaagaggatgattttgtgattccttaaagcatatgacatccacagttcctgcattgtccagagctataagtctctttaatgcttgagttttaatgggattcattttattctctgtttggggacccccatattctacccccttttctgtcattgtgaattatttcccacggtccatcagcataaaagtctgactagcaatgctaaatctgattactttaaaacaattttttttcttctactataggagccttgattagcataaacttgaatctttgtgttagtttgcttaggataatggcctccagcaccatccacagtgttgcaaaagacatgatctcatttttcatagctgtatattaagcattccatgttgcatatgtaccacattttctttatccaatctacaactgatgggcatttaggttgcttccatgtctttgctattaggaatagtgcagtgatgaacatacacatgcatgtgtctttatggtaaaatgatttatattccttagagtatatatccaataaagagattgctgggtcaaatgatatttctgttttaagttctttgcaaaattgccaaactgcttcttataatggctgaactgatttatattcccaccagcagtgtataagcattctcttttctccataaactcactagcatctgtcatttttaagtttttaataatggccattttaactggtgtaagatggtatctcactgtggttttgatttgcatttttttaataattagtgattttgagcactttttcatatgctttttggccgtttatatgcttttttgaaaagtgtttggtcatatactttgtccactttttaaaatagtttttttttgcttgttaatttgcttaagttagttggaggttttttaaggaaaaaaccagaataagagaaaaagaggaaaatataataccacagaaaacacagactgtggtaagtattgcctcgtggatatatgtgtgtgtgtgtgtgtgtgtgtgtgtgtgtgtgcgcatatatatatatatatatatatatatatatatatatatatatatttatgatacatgctgtgtttatgtgtataatgatgatccagaaactaaagggtgactggtttaaggactgcctatgttgcactgaggcttccttcttttcaaattatgaactaaagggtacagcagtacttgcatgactctcaaaaatcctagcagcatgagatagaggtagaggagatttactgagatagatgcattggaagctgtagaagctcgtcctgtgctgttgtggatgttgtgattgtagtagttgttgttagtacagtgggagtaaaagcagcttgaagatttacaagctcttctcttcctcatacttacaactccctctagagacgcatcaatgattgtacaggaatctctgacacctctggagaaatcttgttagctcaatccagaatcttacctgagaaatgttttgagcctcaaattatgtgaaactagggtgtagaaaaaggactagagcaagggaaaataatgttcatgcctgcacagtggttgtagacaggtaaatggggggctttataagtgtgatgatgtgccaaacctctgtcaccacggggagagaagcatcaaaccaggatcacttctggaagaatcattaggttattttagatggaaggaactgtgaattccttgccaaatagatttttaaaattcaaagctactcattacgtgttaatattatttaacttctttaaatataccaggtggtagagggcacatccactatttcaattcagggtttgtatgcctatgtgaattataccattaaaaacacagcaaattccatattggttggggaagaatgtttgaacagtaatcaatttcgtgaagaagaggtttatgtcacagcactttccacagtattacatacaaaaacagtgagtgatctcatatccacaagagccagcatttctcatgtgccacatatgccctcccagaaagaatcaaagcctggttcaagttgatgaaaagggaagtaaaaagaataaagccccaaaacacagcactataaatggaaaggggaaaatcattgcagagcctatgatgataaaaatacaaaagatggatattctgagtatttttatggcaactagcttgacagaagtaacaataaatttgtattataaattacccagaacgaaatttccaattttatatctgcctgactggtgtcttgataccttatcaaaattacacaaattttcaagagattcaaaaagaataaatactcccaaacttatcatatgagatcaccatatactccagtccaaaaataaacaaggacctaacaaacggagaaattaaatgctggtatctcttgtgagcataaacacaaatattctgaaaaatagggaaagaaggaaaatataatcatttttatatctatacgtttgtgagcacacatggttaagtgtattacagtttttatgctaagaacacttgatatgtaattacaagttctaaaaaactgataagaaacagaagatgtgacagttccattttcctaacttttaaaagaatatttcatcttatttaaatattatttttatttttgtatgactttttgttttgcttagacttttagttgaaatgaataatgaatgtgtattaaaagcctaccattttgatttaatctatgaagggtatttaaattctcattctatagaagaaaaatccaaactccttagaaaagagagatcttgccaagagctacacagttcttgtttcagagctgagattttctctcagatattctggctcatacaattttcagtacactacagatagaagatgcaaagacaacattacccaattggtcttgcacttactttgttccctgttaactaagtttactgaaaaaaaataattacaataaaatacactgtcaatgaactgtcacaaataaatacatctgtagaaccacctccaaaatccagacatagaacatttctataactcccaaaagtttgacccactcttttggaatccacttgctttccaccacacagatcagggaattcttgatctgcttattgtcagtgcagattccaatttctttttaagggtttcatgtaaatgaaatatagcatgtgctcttttgcatctggtgaattttgtgtagcataactgcttctcagattcattgagatgtcatgtgttccagttatgtgctcctttttatttttgagtgttatttaactgtttggtaattttataatggatcctttcacctgttgattgccatgtaagttgtttccactttgggctattacggataaagctgctatgaatgttcttgaacaagactttgtatgaacatatctctttatttcttttgggctaatacctaggtgtgtagttgctgggtcttacagtaagtgtttaatactctgttcaactttttccaaagtggctgaaacattttacatgtccaccaataacttattatagctccacaccctccaactgctgttttgattttttttttaagatttcacctaattgtcactcaacagtaaccagaatagctagtgattattaagctatgtttttctgactattttcttgtcaattttggtggttgatgtgtttcaggatattgagaatagaatcaatgccatccaagctccttttcaaataattttatcaagccataatatttaagatggtaacaggatatatacaaggtgtgttgggagtagtaataagtgttttcaacatttattattatcgtactccataaggcaatatgtcttcaatgaaatagtgtttaactagacttaggatagaaaggttctcatctcaaccctagtattcaatattaggaaaagtttaaggaaaaaaaaaaacatccaggaaaataagtcagagagtgttttgctagtcaagaaaaactgcaacactgatgctcttttaatgccaggccttcacaacaatttccactcagatcatttggtggcctccttgccttgttctccttatgggacttcattctgagggcatgtgacatcacagagggagcagtgcacttgggtacagaaatatggcttaggagattgtctggccttagaggcgcctgcaatggaatatacattttcaaggaagttccctgttaaagctgataaattgttagttaaggcaaggtgcaggggcttatgcccattatcctagatgtttgcgaagtcaaggatggaggacagctgaaagccaggagtccaagaccagcctggaaaacatagggagatccccccgtctgtagaaaaaaaagaatgtttggtaagatgtggtgtgaacaatgacatctataagagattatttattaacatttgctcagaaaactagaaaatagaatgatgtcttataatccatcaatatcataataaaaatgctaagtttttcaactatggtaaatatagagaacataacattgcccatcttagccatttttaagtgtacagggcaatggcattaagtaagtcacattgttgtgctatcatcaataatagcaatctccagaactctttccatcttctaaaactgaaactctatttcaattaaatgataaccctctccccatttcccctgcttccagttcctggcaaccttcattcaagttctgtctctatgacagtgactactctgaagcaggttcactgtgccctggttaccaacttatcagagtccagggagacagaacaatcatacacaacaagttacaagaatctggtgtagtatttataggtggccagcaagggactgcagaagcctaggatgtattgtgggtctgtccccttaggcacaggcatgtgggtctgatggaaccttgaccgtgtgtaccccacttggaccataactcagcaaccccagaaagaagatgctctgggtttttaatcctggtgtcacaggacacatggagctaaagtactggaggactaaagtactggaggacagtactaggagaagctggaacaggggcaggctcttctgaccagtctctccctatttcagaatgttacatttccagcacatcctacagttgttcttgagaagtgtaagaaagagagtggggagaactaactgagtcgagaaccattagaggactgtactggagtcacccccaacccagacacccccattagaaagccattccattttatatgcctactaataaccctgaactggtggcagaggtgtgtcttgtttgactgatgaagccccttgacgaacacaatgtcaaagcaacatcattgagccagagccagaatagatttcactgggccaatgaaaactactaccagaggcaggatgatcaggcccaactgaggcagttatgtagcccaggatcccatgatccacagaagaagttgctaaaggggtgaaagaagaatccttcaggtgggcccattttcttcaattacgagcctgtttccagatctcctctacttgaatttctaggatacttgaggtgtttgtccagatacaacaggaagtgttggaaattgtatacaatcctcccagttgggattttaaaaaagtctagagcaacactgttatctaaaacatccatcccgatggagttaacggatgtctgctgggctaccaaggcagtggctatggaggaggagcaatatctgccatggtcagggacacgtttcttatcatttctcttttttacatgagcactgactcctatacatagtaccaaaaatatcacaaaagacataaaccgataatctgttataccttctggcaggtccctagtaagtctgaggtacagctttgggctgcaggctcaatggttcacctaattccaaggagtaatatccagagacaaccccagcatgcccaacatgcagaatctcaccatcccacagttatccagagatggcatcacacatcctgcattttgttcactcccagaccattcacagagaaatatgtagcccttgggtgcatacagccccttttctcccattttattgtttaatcacccagtcatggttatgcaggtattggtgtgttcattagccaagtctcactgatggcagagttgaaggagcaaagtttttctcagacaatattgttcatagacagagggtagcattagtcctctccttgtttttgtctttgccattgggacatttcttatctatgcaatcaaagaaatatggtgcatcaaaatatcagtccaccaatgttttttttagttgtgatcatgacatttgccacacagtcaatttagttaaacggggggcctccagttttctcccatgtggtaggtgtcacatcctcagttggtaggccagtgctcgggtcctgttgatgtacatcatggtatcaggaatgttggcgccatttaccttcggtagagtgaaaggaaacctctagttagtgacagaatgaggtcaagaatggcagattcagtattttgaaagattacactcggtgacttgcaagaagctaacaaagatgttatgcttctaggcctttgctgactcattcttgccaaaatgcagtgtgacaggttagtgcatcatctctcacccatcccagggtctcaggtgtctcctacccatctacaagggttaggctgtgttggtgtaagaatgcggcctggctgtccttgctctgtgaacaatccatttcctttgtcacttgacccagacatttcagtcctgattgtccactgcaggaagggagattatgccctgtaaaaacttgacatatttcataatatcgccaacactaaaggaaggataagatggccctggcaccagaagagggcccctagctccctgatatttcttagtcttgtcatccatcctgtgggatcttgtagaaaagaggcatttagaggaaacataatccccatattagagttagggggcctgtctggggtaagatgatggcctgaattgaaaatcaccccagggcatgcattctaaaggaaaaaaagaaaaagaatggttaggaacactgaaatagctttcacaggtccagactaataaaggaactgcctggtctaccttcgcttccactcagcattatgttccttaacattcattatttcccttgttctggagtgcgatatttaatgcccatattgctctagtaagatggggtaccaccccattagcagactttctagatgtcctttctagatgttgctgtgtgagtccattgttctagcattcactagattcattggcctgtggatgcagggtgcatggaaagttcatcgtgttccatgagagtgtgcctactgtcatgttgcttgggcagtgaaagatgctccttggtcagtgtgaagtgtcattgggtatccaaaaatataacataagttcctctcaagggtgaccttggtagtcccggcatccaattgagcatcgtatctctttttcctgcaggtggaaagctgtggccatagtcctttcctccacaccagggattctttaaaactccagtctctcagttgccattttcctgaacagatgttgaggctgttggcaatggcccatgatttagtggaaatgtggcatggtacgatgttggaacagcctgcatggccatcaccactgaatgtagtttgacccactgggttgaaatcccatgctaagtttcagttaaaaaagtggccatccattggctgaatggtggccacacctagtggacctgtcagtttgtgttttcctcagccatcagtgactcctgccgtatggaaatctctgaatcttgggctcgacatgggtaaatgaaaatccaaattatcacctacaagtcatttggtcccttcaacaacctctccatttgttcatggagccacagatcctgtggggtcctgactaagcctgatcaagaatgtgccatttccatttgataacatgactctgttgagattgttactgccttgaaagccaggcaggtgcttctcaactctgtgattcttcccaggaaatacgtgagaacttccatctgggttcatatctcaaacacaacccagcagtctctcacttgctgctctctgctcaaagtcttcacattgtaatttttcatggggtaaaaagttagcttatatattatcttgtattcattcaaattctgtttaagtaacatacatatgttcctttattctttcgaactttgtccttatttttgaaacccagctttggagttcagaaagctacttttgtacttcaatatgctgtgagtgagactgtgcaaacactttagcaactaggtctttatttttgcatacatttgccacaacatatctagtaattaaaaaatctagactgtgaagagttttatttgggttctccctgaaaaaagtaggataaaatacagtgcttgctggtgttctggtcaagggtctgccttacaaaaagtagagggggggaggtggaggaggggagggaaactgatttaatatcaccaaatcttatcaatgtacatgtactctggtaactgctaaaccaaatcaaaagaatgtgttagctttgtgttgccagtaatcagtctcaattaggtgcctgttatgcagaatgaatttagttgatgaatgaacgtagggaaggaagagaggattagaatgagctctcattgagccttctcttctcttgtgtctcattgctcagagggcacgtggacctcctccatactgcagactctgtcatgcaaaggctgctgcagctgacgggaccttaaaatgtgatgcctgaggtgtagccgagaaatttatggtcatgagccctcagctgcaccaagccctctgagttctccaacatcttcttctttaggcatctaagagaatccacagtgcctgctctccacagaaacagcacatctgggcagctaggccacagcaagtggggaggtttgtgttcaagactctaccattgtgggaggataatgtgtactttgctggcagcaataaaccccaacatcctcagcatccatcctcctgattttagcatgaaatctgtccccgacccactgccactgaacttgtctgggactccagggtcgtgattggaaactaaatagattgggagccaaggaggctggcctggcttctgtaggtaccaattgaaatagatgtatccattactgtgaagggggctgtgactagacctgcaggagatggaggctggctctccaggggtgatgggcagggagagtggaggttgggtcttcgcagcatctccattggatcatgaaataatgagagagaagtgcaaggttatgtgcaaacattgtgagtcattttaatcattttctgtctgttatttatgttttgctcaattatttttgtgtgtgtgattttgattaatcctcccaaaacatacaggtttaaaaagaaccaatatttgcaaggcaaagccggcctctagaagtcacctatcccatccccctctttctgtgtcacagctttcactaaagtacatgtccttgctccttctggaatcttcctcactctcacagatctagacatcatatgccccatcctggaggacaagacacatctaacacgaggacaggacacacatgggaggtggcgggatccacagagttcaccctcccaccccatcatcctccctcatttcccttctgcccttaccagggacccagagcattagcagccccaggagctgagcagggagcctcactgtgagaaggtgaactgaggagtcctgatcagtcaaggcaagggtagagctgagcttttatctcagactcacaaggaaagtcctccctaggggacagtatgcaaatcccctggtgggtgcagtggggtggaaagagccaaggagaaggtgggggcgtctcttgtgagcaaaacgacataaatatattttatgtttttaaggaaatcaatagaggtaaaatctgtgttgcctgagtggcagaagggacgtatttagattttcctgctgtttcctctactagacttctagttctttaggactttctcgggcatgttttatgtttctttttaataagcttgatctttcataaatatttgatgattcttatttctttgtttaggtttatttaaaagagtctaggtttgtttattttattttattttattttattttatctaaggtaaaacacacagtgcaaagggtgcaactcttaagggtgcaaatgaatgtcaagatccagatcatttcatgtcatgatccacatcaaaatacagaaggtttccaattctctcgctgctttcattatgcaccttcccagtcaaaaactgctgctcaaaacacaatcaatgtaaatgatattctgacatatattataattgttttattcatggacttaaactttatatcaggtaaagtaaacattttttgtagcttctttccaatttttttcattttttgaggccttgattccttcttgtcaatttgagttgctgtctgctgtcattttctgttattctgaagaattttctcttgaatctcttacaaggcatatatgctattaatgaattaatctttgtgtatgaaggaatatttctaccttgcttttatatttaaatgattgtttttctggatatagaatttgtggctgacttttctccctcagtatttaaaaatatcattccactgtcttctcacctccatttgtaatgatgaaaatttagccaatgattttaatattgcttcttagtataaagtaagtcggtattttagtgatgcatttcaaattctctgggtctttgtctttcaacactggtactataatgtgtatagttatgaattgtactgtgcttatcctaaaagggtttcactgagtttctttcatgtatagattaaggtgtttcatcactgtgaaaaatgtttttcattatttctccatttttttctttttcaatttttattttaaaatcagagcatacatgtacagatatgttacaaagttattttgcatgatgctgggatttggggtatgactgaacttattaaacaggtagtgagcactgtaccccataggtattttttcagcctctgcccttcctccctttgtctcccctctagtagttcccagtgtctattgtgcccatcaaccgtggattggataaaaaaaaaaactgtgtatagatacaccatggaatcctatgcagccataaataagaagaaaatcatggtcctgcagaaacttggatgcagctggaagtcattttcctaagtgaactaatgcagaaacaaaaaaacaaataccacatgttctcacttataagcgggagctaaacatggggtacacatgggcgtaaagatgagaacacagtttttagcctcttcctgtcttctcctttgtgattcctaatacaaatttgttggtattgttcacagggacctataatgtctgaggttttattcattcttctttataatttttcccttctttatatgaggtcatttctattgacttctttttcagatcactgactctcgtgtcatgttaaattgctgttgagtctatctaatacatttttcaattgagttgttgtacctttcatttttcggattcccagtaggtctgttttcatagttttgtctctttttgagagcctctatttgttgaatcattgtctttacaaattcctttttaagtcttttattataggttaaaataattatttgaacatatatttgataagggtggagcacacagacaccatggagatggaccataaggcagggagctcagaattggattagttgaatttggagtctctgactagatggtgctcttgtgagatttaattattttccatgtttcatgtttctcacaatacaaatagcttttattttttaagatggtaactatgtacagaaattcagcttataaattcctgggaattcctaataggaaaattgatgaaaaaatggtttctcttaggcccccatacctgcctctgcctgggacctgactttgtctctgagccggtggaatctatgatgaggttttgagttgggcagtgaaatcatggcagggcaggctgtgctctgggtgctgtggaggacagggggacactccttcagggtcagtgatgctgggagttcaaggggagactcagcatggagctgcctgttgagtcgccccagcaatcctgtctggacagtgatcatctcacaagtgtactcagatgccagtggatggcccaaatgtgggttcacgttggacaaggacaaagctttagggatgaacatatggggctcatttgatagtctgaagtttcagcacaagcgtaatgaatcatatgggaaaagaaaggagtcacaaggttgtgacttttcatttggtattaaaatatattccctctgctcatttttccctccagaatgtaactactgatacatatttaaccaaagtcattgtttttaattttcattttagtaactgacagcctgtgtgcagagttcctaaataactggaaagccaggccgtcattcctatggctgaagccaggaagtgactgtggatatgaagaaatgtgagtttcatgtacatgtctctaaagccatgggccactgatctggtgggaacctgcagtcatttcactttctcatacccagatgagaggacaccttgatctgtgttcatctgatgatctgatgaactctaaaaactggaccatattctgaaggtctagctcacacttcttttctgtgctagagggactctactcacatgtattgtacactctgcataggacagtctgtgatacatacaagtttttttctgctaaacactcatcaatcttgtcatttatgcgtcttctatacttgttacctgacctatggctatggggtcttccaaaagaataggccagaggtggagctgtgaaactgtagctgaataagaagtgtaagtgtcaagatagggtaaaaaagtgttgataataataataatatttcaaattagtctgggctcttggctgtgattactggtaagtgggaaagagtctaggtttgttttttttaagttttatttcaattgataaagtagccagggtaaagtgcacaaatcttgaatgtgcaactgaataaagtttatgtgtaattcattgtccaggtggaatgatagaatatttcacatactcttgtgcttccctcatggacaatctttgtcagttttcgcccctcccacccagccatagtaactgttattctgacatctaacacaatcacttaggttttcttgtcttgaacttcacataaatagcattaagtgtatttttctctttttagccttgttattgctccttacaatgtttgaggccttcatttcttccagtggactcaaggtcctgtctgatgtcatttcctgggattctgaaggattttctctcaaatatcttataagacatagctgttatgaatgaatgtacttttttatcaaagaaattttgtttttgctttttctttagatgtgaaggtattttcactggatgtagaattcctagtagacttttttctcctttcagcatctaaatatgtcatttcactgcttctaatctctattggtcctaatgaaaacttagccaatagcaatatgttgtttctgtgtattggttgggagatgatgtttgacagtgatcagtttgtgaagcagaggcttatgtcacaatactttccacagtactacatttaaaaatggcgaatggcctttcattcttgatgcagtgaagattttctgtctttcaacatcttaatataatgtgttcagttattaatttctattatctaaaagggttttattgaattttttcatctaagaatattttttattacttttgaaaagtttttgtcattatttctccaaggatttttttttcagccactttctctgtctctcctcctttgtgactctcattatacttttgttggtatccttcactctgagctataaatctctgacgtcttcctcctttttttaaacattttatttagactcaataagttctattcctttattttcaagttaactgattattctgccatctcaaattgttattatacctagctaatacgtatttaaattggattattttacttttcatttctagagttccaatttggtcattttttatattttccatgtcttttcttgaggccctacttgccgaatcttcttaatattttattttttatgtcaatgatcatagttttaaaaataattatttgaaaatctttgtagtctttactaaatccgataattacggcaagttagaatcagctttcgttgactattttctgttgtcattattgtagttgctttatttttgttcctttaatattggtcattcttctcatttttttcccaggagctgttaaactgacaattttacatttttgataatacagtacctctctttagattatgggttttttaattttaatttatttttttagaaatagggtcttactctttcacccaggctggagtatggtggtgtgatcatagcttgctgcagcctcaacctcttggggtccagtggttctccagcttcatcctcctgggtagctgggactataggtgcatgccattactctctgctattttttttttttaaattgtaagatattttgcccacccagcctggtctcgaactcctggcatccagtgatccttctgcatcagcctccaaagtactgggattacaggcttgagccaccatgtcaggcctggaatttgttttgtttttctgatcattttttaattttcttcttagttacttgggtgaacttactgatagtacctgacttatgatgcttggagttataactttttgactttcagatggtatgaaggtgatatgcattcaagtagaaatagaaattctagtatttatacaactattctattttctctttcaatatagtattcaataaatgacatgaggtattcaacactttattggaagataagctttgtgtaagataatgttgcccaagtgtaagctaatgtaagtgttttcagcacatttaggataggataggctgagctataatgttaagtggattagatgtattaaatgcatgttcattgcatgagattgaaaaatctatctcacgtggtgtttgaccactgatatctctgcttccttttattcttaatattaatatttagtttgaatttataggaactgcacatgtatctgcatagtgatgtggtcaccaatgatttgagacgttttgctcaaatatctggaggttataaatctatcttctgtcaacccatctgtgtgtagtttaaaaagcaaactgcatacaaaatgcagctagttcttacctccttctggttttactttgcaccggagactccttgttctcatcactcatatctatatcttctaggtcactaggaatgtgtgcagagattatttcagcaatatgggcctatcttatccaggaatctgctatttactatcagcagatgtactacttgcctcaaacaggtcattgtcttggacttgtaaagctgtgagatttttctgttcatttcctatggagttctgcatgtttagctggaaacactgaagaatttttttccactccttggctttactcaagtccaccccctttggcagcaagctgctagttttatttgctacgctcatattggtaaaactccagttctgtaattcatgctgattgagctgggggtagaaggctgctgtcacaggcaaaaggctacagacattttctgtccttactcaaagcactggtactttttttttctacaaagaatatgcatccttaattattttatacttcaccaattttcagagtgctgaaatagttttgatacttcagctttatatttaaatgtgtgtttgttgtttatttttgcacagaagatttattgaactctttgtgatgccataaacagagatgccttctaaaatgcatttagttgaacataatagccacactgaaatggtatgatgcaatggactaacataagtaattttggacttgacaacttgaactccaaaatggccaaatagagctgagatgctaacactgagtggccaccccactagctgtctgtaaaggaagcagctggtataataatctagtaaacactgatggtcttgttggggtttttgtttcatgtggaatcactgtgggatgccagttgctacgctgctgacagtaataaactgcaaaatcttcaggctctaggctgctgatggtgagagtgaagtctgtcccaggcccactgccactgaacctggctgggatgccagtggccctgttggatgcatcatagatgaggagcctgggagcctggccaggtttctgctggtaccaggctaagtagctgctaacaccctgactggccctgcaggagagggtggctctttcccctggagacaaagacagggtggctggagactgtgtcaacacaatttctccggtggtatctgaaattggaaataaaacagaaatgcactcatgtaatcaaaatcaaacccactgtctttgagtagagccaaaattgttgatctattttgaattttaattatatttcttgctgagcagaggtggcaggagttttcactgatgtgcaaagacacctcatattcccctcacctgggagccagagtagcaggaggaagagaagctgcgctggggcttccatggttccgtctgggtcctaactgagcagttcctccccagagctctgacccaggcattgatatgggctctggaaggtagggcagctgggagggacatgcaaagcagctggggtgggagctgagcttccagctgcagagaccacctgtttcttcctctctgcactgagcatcctgcgccgccctggttgtcaggccagaaaagtctgttggctcagtctgagtgtagaactcctcccttgtgctcagagaatttcattcctatgtctttcttctcctcaatcacctaaattcacccagatgatgtttggcacaagcctgttaagaacaatataaaaggctgtgttttcatttctgtcttcctatcctcaatatgcccagtcatctccctaagtgcattattggatcgatggaaatgaagagtctgttagaacttaatcttccagatacacctttcatttgcttgttagtaatgttttctgagggtcctgaagctttccattaacccagacacataccctctttgagttaaaaagtgaaaaacttctgtttacagtcacatgtcctggcagccctgacatagatgctccatggcttgccgattgcttgcaattgatgaagtaacttaacttccctatgtctcagtttccatatctgtgtaactgtgacaatactggtgcctaccttacagtgctgtagacagtttaaagaaaataagataaaacatttacaatagtattcaggacattatgtatgcggcagttaattttgtttttattgattaaatatttagcactacagtcatcatcattatcataaatatacttacttagcacagaaaagagtcttcagtctaatccaagaatgttttatcaacagtcaaattaaattctagggctttttcttcaccaactgtacacaactcttaaaatcctaatgatttggtcttaatctgtactaaaatgctcagaccttcaatcattcccgcccatctctgtctaacgcattaattctcatcatccattatcaaaatgttaccctatggaagtttcccatgtcctgctgctgtccttctttcttacataatctttattctaccttgttatcttttgtcttacttttgccccaggactgacaataaggaaaagctaccatcattacttgtggacttgctccagtataattttgtcaggcttgttatcttggaagtgaggactatgtcttgcaaagaaacatattcattgggtcaatgtgttatgaaataaaagattttatctacttgtcatccaataattaatttagactgacttgaacagattttttttaaggacgaaaaggagaagatgatataagaggaaaatacaatacagtatcaaatgctagctattatgactcttgcttcatggatttttacatatatattaggcacatggtgtgtatatgtgtgcaatgatgatccaaaaactgaatgctgactggcataaggaatgcctgcattacactgagtcttgtctacttttccaattatgaacagaaagctgcagtagtatttgtatgagtatcaaaacttctagctgcctgagatagaggtagagcagatttactgaaataaaagccttggaagtagtagaggtttgtcctgtgatgttatggctgttgctgtggttgctgttgttaggaaatacagtgggagtgaaagcaagtagaagattgacaagctctgctcttcctcatacttacaaccccctctagagatggacagatgctggtacaggaatctctgacacctctaaggaagtctctttgctttttccagaatctttcctgacaagtattgtatgagtcacagatgaggtggaagtgggtgtagaagaaaggactagagcgagagaagaagttttcagtcccaggtagttgttgttgccacggggaaactgaatttttcaaagatttgtgccacacttctatcgtgttggggagagaggcatcaaaccaggctcactcctgagagaatcattacattattttagagagaaggaactgtaaatttcttgtcaaatagatgtttaaaattcaaagctatcaagaccatcctggctaacacggtgaaaccccgtctctactgaaaatacaaaaaattagctgggcgtgctggcgggcacctgtagccccagctacttgggaggctgaggcaggagaatggcatgaacccgggaggcagagcttgcaatgagcgagatcgcgccactgcactccagcctgggtgacagagcgagactctgtctcaaaaataaataaataaataaataaataaatataaaaaaaattcaaagctactgatttttttgttgttgttgttgagatggagtcttgctctgtcacccaggctggagtgcagttgcatgatcttggctcactccgtttcccaggttcaagcgattctcctccctcagcctcccaagcagctgggattacaggcgtgtgccatcacacccagctaaattttgtgtttttagtagagacggagttttgccatgttggtcaggctggtctcgaactcctgacctctggtgatctgcccgcctcggtctcccaaagttctgggattacaaacatgagccactgtgcctggccctactgatgtattactattattcatcttcttgaatacagcaagtggtaaggtgcaaatccacaatttaaacttgagatttctactcctatgtgaattataccagtgaggaacagaaaaattctgtattgcttgggagatgatgtttgacagtgatcagtttgtgaagcagaggattatgtcacaatacattccacagtattacatataaaaatggcgaatggccttaaacccagaagagtctgcatttctcatgagccatactacccccaagaaagaattgaattgaaacttgtgtctacttgatgaagggtgtataggaagagggaaagaaaaaaggacacaaaacataatattggaaatggaaaggagaaagtcattacacagcctattagagtaaaaaactaaagagaggctaaatgagtaactttttggctactaacttgacaaaagtggtgcaatcttcacctcctgggttcaagcaattcttgtgactcagcctcccaagtagctgggattagaggcgtgtaccaccacttatggcccccctttttttttttttgcatttttagtagagacatggtttcaccatgttggtcaggctggtcttgaactcctgacctcaaacaatctgcccacctcagcctccgaaagtgctgggattacaggtgtgagccactgtgcccggccttaaagcagtattttcatttagtaaagtgtagaagaaaaaacataaataaagtgacaacaagaaaacaaaatgccattatgaaaaatggtaactttagggcagaaaacaagaaaaggcaaaccaagattctcataaggtaagcctccaatccacaatcctaggaggaatgtcaatgctgaaaaccctggagcatccagggagtggccaaaaatactaaatgctgaaaacccagagtacccgagtatcagcctatgagtgtccccacaccaaatgccaggaaaccctggaatatccaggggctgaccagtgcagaaaatcctggagcctcagtggggtggccaacagtgagccccaaaggcctgattgggaccacagaacaatgtgactctggcttcttatggccaacagaacaggagaattcttacatccaagtgtcctgccttaaacaattgcacaaacacaattagcagggagccaaagccaaaactgcaaagcaaacacatatatcagggcagaaaataaaataaaatggctgatggataaataaaatggcattagaggagaaatgactaagagaaggagcaaggaggatgtagtcaggtgtgctatggaggacttcaaatggactatggagtcaaaggccttattccctggatcttccaatatagggcaggtgggcagaggggacacttacaggtgtgcaggagcccaaatggtgccaagcagtctctaacgtggggcctgcgtgaagatctctccaggctccccagcttgggtgggttgggctcctacggaggaactggagcacggagcggctggcctgcatgaagcagtggctctgtgaccacttgcccatccccagggctccaccgcctgtcaggaaagatgatggctcttaaaacagcctttggctagtgttaacagctctgcaatgttagcaactctgtagctttgatcgctgtagcactgatcaccgtctcaccctctttcactgatctctgtcttcccaattctccaatagctgtcctgctcattgctgaccgctatgtccatcttctcacaaaatcccatctcttgctgtctcttgttgtcttgctttctctgctgtttctgctgtctcactgccacatcaaacgctgcctctcaccatctctagagttgagtggctggcttaatcctgatgcaaggcaagttcttggctttgctcaggaaagaacgttagagtaagccggtgattgaataaaacagctttattgatggggcagcagtgttacagctctgtgactaagcctgtggagcaggcataattcataggcagagggccaagagtagcagccaggtgcagttttacagtcacatttatacccacttttaatcatgtgataattaaggggtgggttatcgagaaatagctcgaaaatgggtcgtgttgccccaacttctgggtgttgccatggcagggcagcaatttccaggtgttgccatggcaaggcgctgcgacttctggatgttgctatggcaatggtaaactgtcatggtactggtgggtatgtcttacggagaggtgttttcagaatcctattcctgttttggccagcctcacatctggtccagagtgaagtgctgcctacctcttacctcaaaagtaacaagaaatctgtaataacaagttacccagaaaaaactccaaattttatttggtggttagtgacatggtacttatcaaaattacacaaactttcaagggaataaaaaaaatactcagaattattataggaggtcataatgtcctccagtccaaaaattaatgaggacataacaaaaaaaggatattaaaggctggtatctcttatgaacatagacacaaaaatcataagaaaaaataaaaatggaatccatctgtgtatctacacatttagtgaacacacgttgtaaaaagtgttacagtttttacgataagaactcttgataggtaattttaatttctgaaaaatttatatgaactataaggtatgttggatctctttccctaacttaaaaaatatttcctcgcatttaaatattttccaatttttaataactttttattacttagacttttagttgatataaataagaaatgtgtattaaaagcctaccattttgatttaacctatgaaacacatttaaattcttggaaaaatccaaaaatacctagaaaagtgagctcttgctagaagatacacagttctttagtgtcaggctgagattatctaccagaaataacttttggctcatgtagctttcagtacactgtaagaataaaagatgtgaagacaacattacttaattggatttgcaattactcactattcactattaaccaattttattgaaaaaaaatgattccaatcaaatactctgattttaaatgtactgttgaacaagtacactcgtgtaaatgcctccaaaatcaatacacacaacatttctataactccaaaaagttttgtcctgctcttcaggaatcaacttgctttccacctcacagaacagaccatccttggtcagcttattgttagtatagatttcactttctttttaagaattttacataaatggaatatagcacgtgttcttttgtggctggtgactttcatgcagcataattgtttcctaggctcattcatgtcgccctgtgtcctcatgatgtgttactcttcacttttgggtactatttaactgtgtagtaatttcacaatgtatcccaccacctgctgatagatatgtgggttgtttccactttgggctattatggataaagctaccaagaatggtattatacatggctttgcatgaatatttctttatttcttttaggcaaatacccaggagtgcagttactgggtcttacagcaagtgtttaatactccaccaaactgttttccaaagtagttgtaccattttacatctcagccctgaattgatgagtgttctcaatgtttcagctacttgtttttaagaatttttcttaatcttcactcaacagtgaccagaatggctaatcatcattaagtcatgttttccttacaattctcttgacttttatgggtgcttgacttgtattaggatattgaaaacaggatcaatattgtctaaaccccctttcaaacacttttcctaagtcatgatatttaggatgataagaggagatctaaagggactgctggtagtagtaacaggcattattcaatatttattatcatactccataaggcaatacattttgagtgaaatagcattcaattagactcaggataaaaagcttctaatctcagctttagcattaaatattaggaaacctttgagaaaacaatccaggaagacaaatcagagtgttttgctagtggagaagtgctgcaacacctaaaccctattaatgccagatctttgcagtgatttccactcataaagttgggttgactccttgccttgttctcctatgtgtctgtgtgacttcatgctgaggggatgtgacatcacagagggagaagtgcacttgtgtacagaaacatggcttaggagattggctttggaggtggctgcaatgaaatatacgttttgaagaagttccctatgaaatgtcttataaactgtttcttctggccaggtgctcgggctcacacctgtaatctcagcactttcagtgaccaaggagaaaggatcaggatcatgtaaggccaagaatttgatgcaagcctgggcaacatagggagaccccatgtctacaacacacacacacacacacacacacacacacacacaatttgtgaacaatgtcatcacaaagtgattatttatgaacatttgctcagaaaagtagaaaataaaacaatttcttctgagctaacaatactataataaagacgttagttatttaactatagtaaatacagagaatataagattgtctatcttaaccatacttgagagtgcagagaagtggcattaagtatattcacatgttctgccattattactgacacaatcagtaaaaatcttttcatcttataaaaattaatatgtataccccttaaacaatactccacccattttctctatccctacctccagcaacctccattgcagttctgtctttatgtcaatgacatgtttgaagcaacttcgctgtgcactggttaccaacgtacttgagcgtgggggaagagaacaccccccacagcaagttacatgaagtgggtttattattacagataagcagcaagggaacacaaaattcttggactcattatgggtcagtcccccaaggcacaggaaagctatgtggagctgatggagttgactatgtgtaccccacatacaccacagtgcaggaacccaggaaagcagccactctgggttttgtatcctggggtaaaaagacacacagggctgaagtgctaatggacattctattctatgggaaactggtatagaggacaggtaggttgttctgctcagttcctgtctatctcaggatgttacaattccagcacgttctgcaattgtacttgagaactcttaaaataagcaagaaagtggagagaactaagtcagtccagggtcattgcagaacggtcttgcagttatctcatcccccttagcaaagctagcatacttcatatgcccaccaacttcccctgaactggaggcagaggtttatcttttcagattgatgaagcaccttgacttacacaatctcaatgcagattatgaagccatagtgagagtacatttcactgggccatgaaaagctagtaccactggtaggaggataaaactccccaagcagtgactaagatgttaagaggtgaaagggggatcttttgatgtcctattgtctgcagccagtgagcctgctttatgatcacccctacttgtatttctaggatatctgaggtgtttatccaggtacagcagccagtgttgggtgttggtaattgcatggaaagtccatttgtttccatgagagtgtgcccattgttatgttgattgggcagtgaggctgtttcttggtcagagtgaagtctcatggaatatccaaaaacatgacataaattcctctcaagggtggccatggtagccccagcatctaatagagtgacatatatttagctgtccaggaagcaagctattgccatagtccttttctccactcatgagatcctttaatagttcagtcactcagttgctattttcctgaccagacagctgggctgttggcaatggcccatgatttagtggaaatggagcaaaatatagtgttgggggcagcctgcatggctactatcatttcatgtagtttgtcccattgggcagaatgaccatgttcagtgtcagtcaaaagatgccatcccctggctggatggtggctgcacccagtggatccactggcatgtgttttgtacaatcatcagggccccatgccatactgacacaggcatgtctctgaatctttggctctatgtggccaaaggagaagctaaattgtcccctatgggccatttgttcccttctagcaagcttgccatttattcatggggcacatgggtcctgtgggatcctggttagggctgattctgactgtatcatttccacttaatgatttggatctgttgggcctgtccagttttattgattgtgtttgtaggtaccaaagtgagaatggttagttaaggtcgcagcgtcctgcctggtgctctagctctgagatactcagcccctatcagtttcctacagcaagcaaggagctgccattcaaaagaggcacaactgttggctgcttcaggaaattttgtgtccaaaatctgagtctggtgcacccagtgacactagaatcacctgacatcagatgttagtctgagccctgatgtgtgatacaatgtgaagggttcaggaggggtcattcttcttggcaaattaggtgttcagaagagccagtagcactctaaatctcggttgggggaaactcaaattattgagtccccacagagacctccataacattggttcatgagactcccagggaaagctgggaaagatgactgactgaagtccatgtgttgaatcattctcattattaaaagcccctgctcattaatggcatttcgattagcatccacttggaaagcattttttttttttggattatggctcattttaaaaacatctagtcatagctcttccacaatgactttgtctgtaatcatcctgttgcatttcttttaaggcctgatgatctgtcaaaaccaacagccaatattattaaaatgttattctctttgcaatgtgatcatcagacataggccttgcagtttacccactgttttgatttttacatttccagggcttccttgacaatggcactgatgtgactccatccagcatccattgttgtgagaactctatttggcatatcatcattgtgggcatgaacataatggagactttcataggatgcaatgattaatattcaacattagtcaaaatttcttctagtcctacccttggagctctactgggttggaaaatattttcggacaaggacaatcatttcgtagagttttaaaaataaaggctacaaataaattttccatagcaagagtatgaactatgtgtggtccagaatacaattttttatggaatgtaacaaaaattatttaaatgtattcaatttagataataattttacaaataggcatatattgcatatataatagaattaacacacttaagtatgagtactatatatatagccaacattttatcaaataatatattgacttgtatgtatcttacatacatgtatgcacattttcccataaatatggtaaattttaattttttattgaaatattagttttaattttgtcattaattttctaagtttataatttgattactaaatatttacatttatgccactaatttaagaaaaaatacatgtgtgtatatataggtagaggtgtaaatactgtatcaggaagcttttatgcattaatgattggtaactggctaaatacacaactcagtgacagaaaatagtaaacatttgttttcatgttcatagatgctcacgttcacagtaatctggctgatcaaggaagggttcaggtgagtggtttctctgcatggcactgagctcgtcttcagcctacacatatcaactgtctgaggacaaggctgaacagcaatgactacccatgactcaagattcttctggcaggtcacaagagtgaacagcatcccaaaccaaactgcacagttgagtttaagtccaataatttctaacatagcttcacacatttcaaatatattgctttatttcagtgagtacaaatttttaagaaaatgtttactccatttaattatagaggtgtttgatcattccatggacaaataattatgttttcaacctttacaatattgaaaatatttgcaaatgtaaatttgcattaataagaaaataaagctggatgtgttttcaacatgtggctttaaatataatttatttaaatggcctcatgggggaaaatcattttaacttacataaattctcattttgtctctcttgtttcttatagagttgcccaataagaagtcctcccatgagatttggaagtccgaaaaggatgactcaatattctccattggtacctaagacagacacagggacagacatgaggactagagaaacacctgaaaagatgctgtaggaagctgagagcatcaacacccccacccctaagcttccagacaggactgaggaccatatggttagaaagcccatacttcagaggaagatgcattctgttgcctgagggaggatcagagattcctgcttctaatatcagctttcatgactactatatccttggctttgaaaggttgtagtgggaaacttaatcttaggaatttggtcattcttgtcatacccaacagagcaaagaaaccagtggggaaaggcactcagggtgcaaaatattgtttctagaatgcaattgaaataggccctattatcccatggaactaatgtttatgtttttttgtataaacatagaaattgactcccccagtcttaaaactcaagatagttacatctgtcttatctgagtttttttttgtttgtttgttttttcagtaaaccaatgaacaggcctcccagatactatcaaggagctgaaacttacatatcactgaatcgggacagtgagacatcagaaccttcacccattatgattgcctcactgacctcctgcttcctgttgaccaaattatcttccttacccctccctaattcctgttttcccacatttcttccctgctatataaactcctaatttcagttggtcagggagatacatttgagaatggtatcacatctcctaggctgcagcacctgattaaagcctgttccttggcaatgcttgttgtcttagtgattggctttctgtggggtaagctgcagggtcttcactgaatccctgacatttcagtaacaaaattctctgcaaccttcactgctttggcttattgtaacctgaaatcaaatttgtccacaacttctgagataacttgatataattctaggattcattttgtccaccactgcttaccagtctgagcttgccagctcccaacccttcctagtgccaatgaactttctcaaagagccacaggtaacattttccctttttcataaaatgctaattttctcttcgttcttccaatatcttgaagaccactgagttttcctgtatgccccacctggcaaatatttctttgcaaataaaacttaaatttagagattcatctctacattttattttgactttagtagtttactttaattctctgtattaagacaattcctgcttagaatatctatagtggcttcttctgtgttatatgaattcaagctgaagccataaactagactcctcaagtgtcatgatctctgtatttatcaaatcaggagatgcattgctatgtctgtgcagttggggctgagaaagagaaaagaattagggtgcagaggcgatttcacgtacccctctaccaacaccatcagagtgtggctgcatctgagcaacactctcagccaatggaggcatcaggaggagcagctggggcagcccagcttcacacatctgcttccctgggggtttatgttcgggttggtaacactgtgggagggaaactgttagcctgttgacaatagtaagttgcaaaatcttcaggctgcaggctgctgatagtgagagtgaaatctgtcccagatccactgccgctgaaccttgatgggaccccactttgcaaactggatgcagcatagatcaggagcttaggggctttccctggtttctgctgataccaggctaaccagctgctaataccctgactcgcccgacaagtgatggtgactctgtctcctacagatgcagacacagaagatggagactgggtcatctggatgtcgcatctggaacctgagattggaaacataaaaacaaatgtccacacaattaatcatgctgtaagagaagttccctgaatagtaaagcagtactcagcacactgaccgagtataatcctagtgttctcctttcttacctgggaaccagagcagcaggagccccaggagctgagcggggaccctcatgtccatgctgtgtcctgactgggtctgactcctgcacagggtgtgatcagcctgttaataagtcttcaggtcaggagactgtgctctgggaacatgcaaatgagcaggggatggggcaggctgggcgcagctgcagggctggctcatctcagtaactcagcaccagctcagtgtccccaggtgtcccaggtaagaccagggtagcacaaatttgtctgcagagaatgtgtttctactgggaactattttgttgtgagtaacattttttggtttctttttgacgatttgaaatattcctcaggagttgatggactaatgtatttcattggtgtatggggattatttaggagaatattgttgtttgtaggaaacacatagtaaaatgttagacggtacaattctcaagtcttcaaaagactcttatatgattccggctagggaagggggtatttgtcgtatacatgcaacatttctgtgagtttaacattgttcctatgtaaaaaaattaaaaataaaatttattgacatgatggtacatacatttgtaagtatcaggtaatggtgttatgccattgttcttaccagtatgcgatcaaactatgtactatagatacacaaagatgataccgtgttttctcgatgcatgcaacagtcacagatccacaattatcaagagcgacaggtctctatagtactcagacactaaatgggctgcaccttattcttgttttgggcaccttcatagtctaccttcttttctgccattcagtattatttcccaaagttcatctctcttactgagggtgaccactgcatggagcatgtccctgccatgcaccatcaatgacactttcctcttttactttttatcagtgattggggaaatcattctgacccagacaacagcctccctgttaactgctttaggaaagagacactgaatctcttatcaagcagttgcctatgtacatggagaaatcacttggatccagatgaaactggacagggatttgcactcgttatatctcatatctctaatgtgcccaaaaatgtcccagcctgactcagtagcagggaaagtggatccaactacatcagcatcagtgggctgccacctaggactccacaaaattttactgatgcctgactaggggagccaaatcacagtgctgcaggctgtgcacaaaccttcctgctgttttttaagctgcctgaattttaagggaacttgcttatattgggagaaaggaagaaagctccatttgtcctctaaatatttgctgaaaatgaatggacaaaagaaagattaataagagaaaagacaaacaaaattcatttgaagtgcagcagaatatcatagcagggtgattacccagataactcaatgggatacagttgtttatatttcttttctaaggaagagggaattgagaagcgtaggcaacctggaaagaatagatgagaacagaagtgcatcctcaaaagaacaggtcatagcctgtctggataaagcatcaacttcagtctcttgtattttagattcctcttttgtgttaatattccctgatgtaaaaattctcaggaagaatttttttgacaattggtttccttctggagaatctgctattatgcagataagggacatttaggaaaagtctttttgtgcatttggtgctttctaaatgtctttggttttacataatcatcataccagtgcagcatagtttgagatgttattttctggattcctttacttgcaacccacctgccaagatcctgttccagagagatgcagctacagattgaatgagcagttgacccttgaacaacatggaggtttgggcactgaccatgggtgcagatgaaaacctgtgtaaaacttttgcatttctaactccaggcatcatcttgaaagtggagaaagcagaccttaacctgcccatgtcttgatctttaatttcccattctccagaactgtaagaaaataaatttctgttccttatgaattacatagtgacaattaatctgttatagcagcttgaaatagaacaagagagacagcgcacaatcagtgaggacacgatgaggtgtatacataccccagcttcctcatctctcaggtggaatagcccagaggaacttagtccatgtttcctcatgtggttgatctttggttatcctgagtcaggtaggttgttgatgtgtctttttccattcatcttctgttctcttcctcactttcctcctttcctcccagtgtaaatttgctgcctaaacagggatcctcattgagggtggacccaaactaagatagttaaaaaaaaaattgttaatcttttgtaagaggggtatttctcatctgaattctgataatttctttttctttgacatgtaggaatattcaggaggcacttaattttttttttttttttttaccaatctgttttacattcaatttttgaactgattttgtttttctgtgtgttaaaaccaaaaattaagttgtaagccaccaacctgctgaatggactcctcttttgtaaagagcacttcaaagaaatttgaaaaactaggttaggccatgactggcaggtgggtttagatgtgcctcattatactttggagttcagacacaactgaccaacattgtcattacaacagagatctttgggctgacaaaacagacgctttgtagcattaagataccatattccaacatgacagataataggccctgaagaaaatctaaatattttaccttaaaaatatttcttcatcatattctgaagtggttctgcaaagctgccagttgtgggggaaatttgcattctatagagaatctcctccccttactaagtcttttttaaagtctgacattttttaaagctctgataagcaacattcaccttgtactttatctgctactgataggattcatctacatgacaagaaccttggcttccacatccccttgtctacactcaagcatttctttatgatgaattcaactctttagacagaccttaactctttcaaccagtagccagtaaggaaagctttgaattcacctatgacctggaagcccctgcttcaagctatcccacctttccaggacaaactaatgtatatcttatatgtattgatttatgtctttccctgtatttctgtgtttccctaaagtgcttaaaaccaatgtgtaatccaaccgccttgggcacatgtttacaggaccttctaaggctgtgtcacaggccataagccttatctttggcagaataaccctgtaaattgattgagacctgtctcagatactgttttgtttatactgggtcacaaaatttaaaaatcctctaaaactatctacacatcaataaatctacattagagacagtggagtgagcataccccaacagataaaactcacaagttagaggaacctgagtctaagattttgtccacctcccttgattcataaaaatacttcgtgattttttaaattttactttagagaaggacaattttggggaatatgtttatggtcggtggaatgaataatatcccaccccaaaggatgtccatgtcctcatctctggaacccaagtgttataggagtttttaagaaattattttaggcagataggaaaaggggtccttgggaaggttttgtttcctttaaagcagctctagaaacacttcttgtctagccagaaagccctggctcttagagccaggctgggaagctttcctatgcaaatcatagccattagaaactggattcacccaaacatggtgattcccaccattttcttccttgtcaacacatgtgcctgggaaaaacctgaaagatgctataggaagctgagagcagctgcaaccccacccttaagctttcagacaggactgaggaccacatggttagatagcccatacttcagtggcagatgcattctattttctgagggagtaccagagaatcctgcttctactgtcaacctgcctgactactatatccttggctttgaaaggttgtagtgtaaaagttaatcataggaattcggtcattcttgacatacccaacagagccaagaaaccaggaggaaaaaccactcagggtgcaaaatattgtctgaagaaagcaattgaaataggccctattatcctatggaactaatgtttatgattttttgaataaacatagaaactgactcccccagtcttaaaactcaaggtagttacatttgttaatctgagttcttttttcaggaaaccaaccatcaggcctctagatactatcaaggagctgaaagttatatatcactgaatggggacagtgagacatcagacccttcacccattatgattgcctaactgacctctagcttcctgttgactaaattatcttccttacccctctctaattcctgttttccacatttcttccctgctatataaacccctaatttattttgtcagggagatacatttgagaatggtgtcccgtctcctcggctgcagcacctgattaaagcctgttctttgacaacacttgttgtcttagtgattggctttctgtgtggtgagccgcaggatctatactgaatccctggcatttcagtaacaaaattctctgcaagcttcactgctttggcttattgtaacctgaaagcaaatttacccacaacttctgagataacttaatataattctaggattcagtttgaccaccactgcttaccagtctgagcttgccagctcccaacccttactacagccaacaaaatttctcaaagaacaataggtaataatttccctttttataaaactctttgctcttccaacatattgaagaccattgagttttcctgtatgccccatttggcaaaaatttcttagcaaataaaacattaaatttatctgtacattttatttagacttcaatactttagactctaattctatctattaagactattcctgcttagaatatctataatggcttcttctctgttatatgaattctaaccaaagccataaactagactcttcaggtgtcatgatctctatctttattaaatcagcagaggcattgttatgtctgtgcagctggggctgagaaaagaaaaagaaattgggatgcagaggtgatctcatatcctcctctaccaacaccatcagagtgtggctgcatctgaggaacactctcagccaatggaggcatcaggagaagcagctggggcagcccagtctcacacatctgcttccctgggggtttatgttcgggtttgtaacactatgtgagggtaattattaaactgttgacagtaataagttgcaaaatcttcaggctgcaggctgctgatggtgagagtgaaatctgtcccagatccactgccgctgaaccttgatgggaccccactttccaaactggaggcatcatagatcaggagcttaggagctttccctggtttctgctgataccaggctaaagcactgctaatgccctgacttgcccggcaagtgatggtgactctgtctcctacagatgcagacagggaggatggagactgggtcaactggatggcacatctggcacctgagattggaagcataaacacaaatggtccacacaattaatcatgtagtaagagaatttccctgaatagccaggctgtactgagccccctgggctgagtaaactgttagtgttctccttccttacctgggagccagagcagcagaagccccaggagctgagcggggaccctcatgtccatgctgtgtcctgagtgggtctgactcctgcaagaagtgtgaccagcctattaagaagtcttcagggcaggaggttgtgttctgggaatatgcaaatgagcagaggatgggcaggctggacacagctgcagggctggctcatctcagtaactcagcaccagttcagtgtccccaggtgtcccaggtaagaccagggtagcacaaatttgtctccagagaatgtgtttctactgggaactattttattatgagagacattttttaggttttttttgacaatttgaaatattcctcaggagttgatggagtaatgtatttcattggtgtatggggattatttaggagaatattcttgtttgtaggaaatatataataaaatgttagacggtatgattatcaggtctccaaaagactctcatatgatcccggttagggaaggggttactttgtcctatacttggaacatttctgtgattttaacattgttcctttctaaaaaaatcaaaaataaaatttattgacatgatgctatatatacctgtcagtattcggtaatggtgttatgccattgttcttaccactataagatcaagcaatttactacagatccacagagatgatgcctatgtacatggagaaagcagtttgatccagacaaaactggaaatgatttgcaatcattatatcgcacatatctaatgtgcccaaaactgtcccagcctagctcagtagcaggggaagtggatccaactatattagcatcagtgggctgcagcctagggctccacaaaattttactgatgcctgagtaggggagccaaatcacagtgccatagcccgtgcacaaaccttcttgctgctttgtaagccgcctgaattttaagggaacttgcttatattgggagaaaggaagaaaactccatttgtcctctaaatgtttgctgaaaataaactgacaaaaggaagattaataagagaaaaggcaaacaaaattcatttaaagtgcagcaggatatcatagcagggtgattacccaaataactcaataagatccagtagttcatatttcctttccagcgaagacggaattcggaagtgtaggcaatctggagagaatagatgagaacagaagtgcatcttcaaaagaacaggtaatagcctgtctggataaagcatcagttcccagtctcttctatttttgattcctgttttgtgttaatcttccctgatataaaaattctcaggaagaagttttttgacaattggtttccttctggagaatctgctttttggcagataagcgatgtttaggagaaggctttttgtgcatttgctgctttctaaatgcctttggttttatgtaatcctcatacgaatgcagcatagtttgagatgttattttctggattcctttacttacaactcacctaccaagatcctgttccagagagatgcagctacagactgaaagagcagttgacccctgaacaatgtggaggttggggcactgaccacaggtgcagatgaaaacctgtgtagaacttttgcatttctaacttaagtactaatagcttacttttgactgctagccttaatgataaaataaatagttgattaacacttttttaagttatttatatcatatactctattattccaataaactatgctaaagaaaaaaatgtaattaagtaaattataaaaatgagaaaatatatttactacttattaagtacttgcttacaggtgacacacacagaagaaaatacaagtggatctgcaaatttcaaacccaatttattcaagggttaactgtaccaggatgaatataggagtctctatctgtattctagggctttctctttgctgtacctctgctcacttccaatggcaatatacatgtcttatgttctttacagtcttgggcagagaactctgcctgcatgcattgctgaccaaatgacctggaaagtgtatctcttaggaaagtgctatggtttcactgtgtcctccagaatccatctgttgtaaagttaattctcagtgtaatggtattgccaattggggcctattgggatgtgtttagatcatgagtgtggtgccctctagtggaatacattaatgccagtataaacagcaattgtggggctgggatctctctctcttctgcttgtctgtcatgttaagacatggccttccttcctttgaaggaccccaaactccaggcatcatcttgaaagcaaagaaagcagaccttaacctgcccatgccttgaacttaaatttcccattctccagaagtgtaagaaaataaatttgtgttctttatgaattactcagtgaaaaggaatctgttacagcagcttgaaatagaacaagagagacagctcacaatcagtgaggacaggatgaggtgtatacatacttcagcttcctcatctctcaggtggaacagcccggaggaatttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagtaaaaaaaaaaaaaaaatcgttaatcttttgtatgaggggtatttctcatctgaattctaataatttctttttctttgacatgtaggaatattcaggaagcacttaatttttctttaccaatctatttcagattgaatttgtgcagtgattttgtttttctgtgtgttaaaaccaaaaattaagttgtaggtcaccaacctgctgaatggactcctcttttgacagaaagcacttcaaagaaatttggaaaactagattaggccatgactggcaggtgggtttagatgtgcctcattatactctcctccctttggagttcagacacaactgaccagcattatcattacaacagagatctctggactgatgaaacagatactttttagcaataagataccatactccaatgtgacagataataggccctggagaaaatcaaaatattttatcctaaaaatatttctttgacatattctgaagtggccctgcaaagctacctgttgtgggggaaatttgcattctatagagaatcttctccccttactaagtcttttccaaagagtctgacatttttttctaaggtctgataatcaacattcaccatctactttatttactacccataggattcatctacatgacaagaaccccccattttctagactcaagcatttctttatgatgaattcaactctttaggcagagcttaactctttcaaccagttgccagtcaggaaagctttgaatccacctatgacctggaaacccctgcttcaagctatcccacctttccaggacaaacttatgtgtatcttatatgtactgatttatgtctttgcctgtaatttctgtgtctcctaaagtgtataaaaccaacgtaaaatccaaccaccttaggcatatgtttgcaggacctcctaaggctgtgtcacaggccataagccatatatttggcaaaataaacctgtaaattgattgagacctgcctcagatagtgttttgcttacactaggtcacaaaatttaaaaatgcctaaaccgcagcagcccggcattcctccaggacctcctcccctgggatcttgcttcaagtgctggaaatctggccactggaccgaggaatgcccacagcctgggattcctcctaagccgtgtcccatctgtgcgggaccccactggaaattggactgtccaactctcctggcagcgactcccagagccactggaactctggcccaaggatctctgactgactccttcccagatcttctcagcttagctgctgaagactgatgctgcccaatcgccttggaagcctcctggaccatcacagacactttgggtaactcttacagtggagagtaagtccatccccttcttaatcaatgtggagtctacccactccacattaccttcttttcaacgacctgtttcccttgccaccataactgttgtgggtattgatggccaggcttctaaatctcttaaaactccccaactctgatgcgaacttggacaacattcttttatgcactcctttttagttatccttacctgcccagtttccttattaggtcgagacgttttaacaaaactatccacttccctgactattcctgggctacagccacacctcattgccacccttttcctcacttcaaagcctcctttgcatcctcccctgtgtctccctgccttaatccacaagtatgggatacctctactccttccttggcaactgatcatgcaccccttaccatcccgttaaaacctaatcactgttaccactagagcgtgttatcacccacctgttacaacatggcctcttaaagcctacaaattctccttactgagggaagagagagaccctctcatattgttttatattgttttatactcagtacctgttttaagagtaaaaatcaaggaagtgaaatcagagacaggcagcccggcgccaggcctgggcctgcctggcctaaacctagtagttaaaaatcaactcatgacttagcaaccaatgttatccatagattccaagcattgtatggaagaacattgtgaaactccctgttctgttctgtttgactctgactaccagtgcatgaagaccctgttacataacccctagattgctcaatcaatcacgaccctttcatgtaaaatctttagtgttgtgagcccttaaaatggacagaaattgtgcactcaaggagctccgattttaagacagtagcttgccgatgctcccagctgaataaagcccttccttctacaactcggtgtctgagaggttttgtccatggctcatcctgctacattacagctcccctatcctacccatccaggaaccagacaaatcttacaggttggttcaggatctttgccttattaatcaaatcgtctttcccatccaccttatagtgccaaacctctacaccctcctatcttcaatacccccttccacaactcactattttgttattgacctcaaagacaccttctttactatccccttgtatccctcctctcagcctctttttgcctttacttggactgaccgtgacacccaccaatcccaacaactcacctggactgttctgccccaaggcttcaggaacagcccacactacttcggccaggccctttctcatgatctgctttcttttcacctgtctgcctcccatcttattcaatattttgatgatcttctttgcagtccctcttaccaatcttcccagcaggacactaccctgcttcttcaacatctctatttaaaggggtaccgagtatccccctccaagacacaaatttcttcccctagtgttacctatctcggtataatcctccatcagcatacacatgcccttcctgcagactgtgctcagttaatctcccagacccgaatccccaccacaaaacaacaactcctttccttcttaggcattgttggatatttccgactctggataccaggctttgctatcctaacaaaaccactttacaagctcacaagaggtaacttaactgatcccatagaccctaagttttttgcccattgttctttttgctctctcaaaaaggccctggagacagctcccacactagcactccccaactcgtcccatgctttttccttacacacagctgaaatacaaggctgcgctgctggagtcctcacacaggagccaggcccacgacctgttgcctttctatcaaaacaacttgacctcacaattctggtgcagccctcatatttgcgtgcagcagcagctgctgctgtaatacttctggaagccctcaaaatcacaagctatgctccacttaccctctacagttctcacaaccttcaagcattaatatcctcctcacacctttcacacttactgtctgcccctcgactcctccagctctattcttttattgaaaccccaacagtaactattggccatgggcacgatttcaacccagcttctcagttagtaaccaacacaagtcctgaaccacgtgactgtatttccctaatacacatagcatcttcctcctttccttgtatttctattcttcgaattcaaaatccagaccacccaatcaattttcaccaggtaagctggatatgctgtcatgtcccacatctctattattgaaactgctgctcttcctccctccaccacttcccaacaagccaaactgattgctttaactcatgtgctctctctcgctaagggaatgcacattaacatttatactgactccaaatatgctttccacatcttccataaccatgctgccatctgggctaaaagaggcttccttaccacacaaacctcttccattatctatgcctccctaataaaggccctccttaaggctgctctcctgctggccaagcctggagtcattcattgtaaaggacaccagaaacctactcatcttattgcaaaaggaaatgcctatgccgacaggacagcaaaagaaataaccaatgcctccacacccgctaatattccagctcccactccagaggaccagtatttttcttccttatctatcactaccacctactcttttgaaagcctgctctactagtcttttccaactcagggaaagtgcttcttaaatcatggaaaattcattcttcctgcctcacaagctcagtccatgctttctttccttcatgaccacttccatgtgggatacaagcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcgtggatttactccaacacaagattggcagattgacttcactcatatgccccatatctgtaaatttaaatatctcctggtttggattgacaccttcactgggtgggttgaggcatttcccactatctctgaaaaggctactgcagtcatttcttcccttctaacagatataattccctgatttggcctccctacttctattcaatctgacaatggtttggcttttattagtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgccttcaagatgctacagggtacagtccatttaaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaacgatcagttcttgttaagggtctgagccctcaaactctacagcctcgatggactggaccctatctagtcatctatagcaccccaactgctgtccatctgcaggaccctccccattgggttcaccattccggaataaagctgtgtccatcggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgccggtttacactgtttctccaaaccatcacagctgatatctcctggccctattgccaaaccaccactcttgactccctcttggagtggatagatgatctttgctggcagggcacactccaatattttcaccatgatgaagtcctattctttttttttatactcactcttattctcattcccattcttatgccaccctctccctctccccaactatctccactacactatcagtctcactcactctctcccagccatttctaatccctccttagtgaacaattgctggctttgcatttccctttcttcctgcgcttacaaagctgtccctgccttacatacctactgggcaacatctcctgtctccgtacatctccgaacttcctttaacagccctcacctttaccctcctgaagaacttctttactttctagacaggtccaggaagacctccccagacatttcacatcagcaagctgctgcccttcttcgcacttacttaaaaaacctttctccttatatcaactctactccccccatatttagacccctcacaacacaagctgctattcttgtggctgctcctttatgtatctcttggcaaatacccactggaattcccctgggtaaccttgcatcttctcgatgttccttcactcttgatctccaaagcccagctacacataccactgaaacaattgtggctttccagctccatattacagataagccctctatcagtactgacaaacttaaaaacattagcagttattattgcttaggaagacattaccctgtatttcactccatcctttgctgccttccccttgctcttcagactctcctcccaggccctcttcttgtttgcttatacccagccccgtaaataacagtgaaaggttgctcatagacactcgacactttctcttacaccatgaaaatcgaaccttcccctctatgcggttaccccatcagtccccattacaacctctgacggctgccgcgctagctggatccctaggagtctgggtacaatacacctcttttagtactccttctcatcttttcactttgcagctctggtattgccttgcacaaggtctcttcttcctctgtggattctctacctacatgtgtctatctgctaattggacaggcacatgcacactacttttcctaagtccctagattcaatttgcaaatgggaccaaacagcttcctgttcccctcatgaaaccgacacgataaaaaagtgttattccactaattcccttacttgtcagtttaggactttctgcctccactattgctctcagaactggaatagcaggcatttcaacctctgtcacaaccttccgtagcctttctaatgacttctctgctagcatcgcagacatatcacaaactttatcagtcgttcaggcccaggttgaatctttagctgtggttgtcctccaaaactgccaaggccttgacttgccgctgaaaaaggaggactctgtgtatttttaaatgaagagtattgtttttacctaaatcaatctggcctggtatatgacaacataaaaaaactcaaggatagagcccaaaaactcaccaaccaagcaaataattatgctgaacctccttgggcactctctaattggatgtcctgggtcctcccaattcttagtcctttaatacctgtttttctccttctcttattcagaccttgtgtcttccgtttagtttctcaattcatacaaaaccgcatccaggccatcaccaatcattctatatggcaaatgctccttataacaaccccacaataccaccctttacccgaaaatctttcttcagtttaatatcttctacactatgttcccatgccacccctaatcccactcgaagcagccctaagaaacaatgcccattctctctacataccaccaccaaaaatttttgccaccccaacacttcaccactattttgttttttcttattaatataagaagataggaatgtcaggtctctgagcccaagttaagccatcatatcccctgtgacctgcatgtatgcatccagatgacctgaagcaactgaagaacaacaaaagaagtgaaaatagccagttcctgccttaaccgatgatattccaccattgtgatttgttcctgccccactctaactgatcaattaaccttgtgacattgcttctcctggaaaatgaatctcaggagctcccccacaaagcaccttgtgacccctgaccctgcccacaagagaacaaccccctttaactgtaattttccactaccctgcccaaatcctataaaactgccccacccctatctccctttgctgactccttattcggactcagtcagcctgcacacaggtgattaaaaagctttattgttcacacaaagcctgcttggttgtctcttcacacacacatgtgtgacagattacagccctactgacaccttaacattagctcagtgagacttctgacacggggtactatattttatttgtgtgaagccaataagactgtggtgatttaaacagcagcattggaaactaatgcaaggggaagagatgtctttcacctcactgagagcatggttgtcctctgttcttggaaatatttccaccttgttatctggtgtcaattatgacatattttctagtatttaaagaaaagatctgctgccctaaaatcctatgtccagtaaaattattatttagaaatgaaggacaaattgagaagtcctcagttgtagaaaaactaagagtatttgctgccaacagatccactttaaacataggcaaaatgagccctaggaagataaaactaaagataaagagaggatattaaataatgttagggacaaaaggctacaaaaatgagaagatagatggatataatgcattgctaaatcatgtgtgatagttgtatcaaagttgtaatactgtttttttcctaatatatgcagataaattacttttaaaaaacaatctatttacaatgggggaggaaacatgacataaaaaaggtaaaattctatatttattttaaatggtaatatattgatgccaacatactgtgagaagctatgcatataaaggaaataccatgacaaccaatttgaaaatcattataaaaagagataccccaaaattaggcaaaattaaaatgaaattgtaaagatgttcaagtaacccaaaagaaggcagcaaaaagaaaacagagaagcaaaaaaagatacagcaaaaaagtagagtgcagacttaaattttaatatatcaatatcaatatattaaatatgcaaattatgaaactttgaaaaagacaacaattgatgaataaaaagaaatgtcccaactgtatgttatctacaagacactcacatcaaatataacagtataagtagattgaatataaaaggaaggaaaatggtatactatgcaaacattaataaaaagaatcagtagcaaatactaatatcagataaagtagactacagagccaaagaatgttaccagggacagaaaggtacattacataatgaagaaagtcattttggaaagaagacagagcagttctaagtgcgtagacaccaagcaaaagagcgatatagtgcatgtggcagaaactaacaaaacaattgcacacggagacttcaaaaccccttgttaatcttcgataggacaactggacagaaaatcagcaaggatttaggactcaacaatatcatcaacccacgagatctaactgacatttatagaacactccaacccataacaatagaagttcacatttttttcttccaagtgcccacaacatataccaagataggacatatcctgcccacataacctctcaacatatttgcaataattaaaatcacagtgaatgtgttctctgaccatggagggatcaaactagaaatcaatattgaaaatgtaacctccaaattttcaaatatatgggaactatacaatattgttctttccaaagaaccagcctttggtttgcctggtgttcagtgtcactttttctgtttgcagttttattgatttctgccctaatatttattatttattttgctcatgttctacttcagatataaattgctcctctttatgtagtttcataaggtggaagtggagattattggttttatcccttttattttctgaaaaatactcatatgcatatgtttatctacatgcatacacaggcataaatatgtgcagatgcatattcatacacgtggttttaataccataaattaccctgtaagcgctgctgaatacctatgcatattttcttttctctgagctcaaactccactcacttgcaaacctgcccacttaatctgcatgttcattggtgtctcaatctagaattgagcaaaaataacaaactcctttcattttatctcaactttcttggccgctaatacatttaacatcagtaagtcagaatctatctaatagattaaggccaaagctgccaggtcactcctaatctgactcttctcacaccaaggagtgtaaatgacattgatttaaaaatatggtatcatctgcctatgtctccaacaatcttcactgccccaaaactagttaatgccaggatccactttgcccagataagcatctcttctgcttctcacagcccaattcgagtcattactttgctaaaaaataaatatgaccatgggggtactttggttaaaaaaattcccagaatgtcctgctgtacctacaaaacatttgctccccaaacagaaaatgaaggccttattaatttcacatcagtcacatgtggtgatctttaagacactgagagaaaatgtctctgacctgccccctcacaaactttctcttttttacctcagttaagtcactctcctcatagtgcctttctctgtccttcacacgttcatactgtattccttctaagcgccttgattgtcatgaacctcagtgcccttcagaaacttctcttcaggtcagttgttctcctcatccaggtcagtcacctcctcagaaaaagtagcctctacctccctaactaactgactccttttcctcattaaccacttcctcttcccttgccatttttttcctttatgacccttaactttttctagaatctttttgttgatttatgtttaattagacatggcctttttttcaccagaaaagatataggtaaatgagagtcagacactgactttctcaggggtgcagcctagatacgttcctggaccagcatagttgctcaattaacactttattgaatgaatgaataatgaaaagttaataagaaactctccaagacataatcaacactcttaacctatacacattgaaaacaacccactgaatgtaaaacatggattattctgagtaatgagaagtttgaatagcagtgtgctgctcttcatagtcagctcttcatagtcagtgtgctgctcttcatagtttgtattttgctggggagataaggaagacatccaaagtccatgataatcaggtaagagtattcttatcttttttaaaaaacaagcaaatagactttgcagtcacaaaaaaattgcaataaatgggactacactatcacttaactctattggctcctgttcacaaaaacaggttgtattattaactcttctttgaaaacaaaccagctccaaacaaaatgccataaaatgagtatgtacagtcctccctcagtatccatgggaaatagtttccagggcaccctgcagatattccaatttttggagactcaaaacctttatgtaaaatgcacaatatttgcatataacctacacatatcctcccgtacatttcacaccatctctagcctccttatagtacctagtacgatgtctacacatgacttaacttgtgtagattcatccaagtgttactcagcacatggcaaagtcaagctttgctttttggaattttgtggatttttttttcaaaatatttttgatccaggattagttgaatccatggatgcagatcccatggatagagagctgactgtacagctccttataattctgagggtcagctctgtggttcttccattctgggctggctggactgatctctgctgagtccgctcttgtgtctgcagttaccctgtggttcatttgtgactggatggtctgatgtgacttctttaacctatctggaagctggtttgatgtgcaggttggacaacttttggtatcggtttacatgggtcaggaagatgggtcctattccccaatctgtattaggtttgttcccagatcaactctggggttcaagtctattcattgtgggttgtttgggagaaattctacatgaacaaagctgaactgctgtcatttattgctgttagcagttattgttatcctctgaaatgcatcttatataaccaagatctccccagggtggcccaacagtacagctcagctcagcccatcctgtcacttcgctggatgactgcaggtatgagaaaggcaatatgctcagtcacaggaaaggcaggggcccaccctggggctgaaacctgcagacacagcgttcacacagcttctttgcaaaatacgaagacttcattttctttatacttaagatagttatacatttttttctataatgtccctatgctatttaactaattttaattttcagaactggttgtatttattatttctgtgttaggtgctcttagtcacttatggcaagagtgagttaatagagacaacatacagattagccatggaacaatagagaagtgtgtgtattcagacaggataaagatcaaaggggtgacaaatacattcttttgagaagcagattctcatagatcaccacaagtcaaggtccacattcaaggtgcagtggcgtgtcagtcacattgtgcaaatggtcagctctgcacattaaacttggctagcacattgcaggaccaaaattacctataaaggtatggggaaaataaaccatcatggaaataacaatttgaaggagttctcaattatttatacttggatataaagcagaacgctacaatgaatgaacctacaacctaaaacctttaagccttttaaagaggtttctttttgtcagggtatttctcagcaaataatgataaaaaatttatggataaactacttgcacaattagccacaataaatcccttccctgtactcatcctttggttggcctcattctaaatggatgcaggtgttgcccatgtgtcttgctcaggccaataggataatagcagatgtgacacaagtggagtcttggaaagggcttgcacatcgaagctttcctctctctcacagtgcttggaaaccctaaggtcacaatgagaataagactgtgcccatctacagtcaatgtcagtggcatggctgctcttcggtctactatttgttcttaaaatgtgtgctaagtttgttatggccatgtaacaaattaccacaaatttatcagcttaagactacacccatttatcatctctcaatttctgagtcagcagtcggcacatggctttgtcgggtcctggccattggatttcacaagaatgtgccacagtgtagattgggcttcattctcacctgtgagtcccctgagaacatagatactttagagctctttcaggtagttgcagagctcattccttagcatttctatgactcagagcttcaatttctaactggctcttggctcaaggttgctcttagttccaagaggctgtggacaattccctgccatgtgatgctcacacaggcaatgcccacatggctggttgcttgttcatggtcagcagaaggtttcagagagtgtctctttccagtctgctatgacagaggcttatcgaatacaatcattggaaagacatctcataacctatgacatatcatatggattagaagcaagtctaggttccgcttgttctctgtggaggtagattatacaattgtgtgattcactggggagagggttctgctagggtgttctggcatctttagtttcctcaaatatcaggtacttgtactgagtgtgaaatctgtcctgtacttactggcattgactagtcctgtgacccctgggaacatcttgggaagcatactttgtaagagaggttttagggtaacctagctattggaagcataacatttgcaaaatatcctaatctttgtgatttctaacatgtcctcaaggttccttaattgcaattatcataagccaattatctctaaatatctgcaaaatttatatttaatagtaggaaaatgatttattaaggagtctattaaacaagactcagggaaatgatgtcaacacctaattgctgctgcccactgctagactatgtgagacaattttcatgaacaatagaacagatactgcatgctagacactgctgtgagcaccactggcctgctacctctagaaatgtttgcagaacgagggcaattgctatgagtctcaaaatataattttttttattatactttaagttctagggtacaagtgcacaacgtgcaggcttgatacatagggatatatgtgccatattggtttgctgcacccatcaactcatcatttacattaggtatttctcctaatgctatccctcccactgcccccgaccccatgacaggccccagtgtgtgatgttcctcaccctgtgtccaagtgttctcattgttcaattcccacctatgagtgagaacatgaggtgtttggtttcttttccttgtgataggttactgagaatgatggtttccagctttatccatgtccctgcaaaggacatgaaatcatcctttttatggctgcatagtattccttggtgtatatgtgccacatattcttaatccattatatcattgatggacatttgggttggttccaagtcttgctattgtgaatagtggcatgataaacatacgtgtgcatagtaccatgatttataattctttgggtaggtacccagtaatgggattgctgggtcaagtggtatttccagttcttgatccttaaggaattgccacactgtcttccacaatggttgaactaatttacactcccaccaccagtgtaaaagctttcctatttttccacatcctcgccagcgtctattgtttcctgacttcttaatgattgctattctaactgacgtgagatgatatctcactgtgattttgatttgcatttctcttatgaccagtgatgatgagcatttttcatgtgtctgttggctgcataaatgtcttcttttgagatgtgtctgtttatatcctttgcccaatttttgagggggttgtttggtttttttcttgtaaatttgtttgagttctttgtagattctggatattagccctttgtcagataggtagattgcaaaaattttctcctattctgtagattacctgttcactctgatggtagtttcttttgtcatgcagaagctctttagtttaattagatcccatttgtctatgttggcttttgttgccattgctttggtgttttagtcatgaagtccttgcccatgcctacgtcctgaatggtattgtctaggtgttcttctagggtttttatggttttaggtctaacatttaagtctttaatccattttgaattaaattttgtataaggtgtaagtaagggatccagtttcagctttctacatatggctagccagtttttccagcacgatttattaaatagggaatacttccccatttcttgtttttgtcaggtttgtcaaagatcagatggctgtagatgtgtggtgttaattctgaggcctctgttctgttccactggtttgaatctctgttttggtaccagtaccatgctgttttggttactgtagccttgtagtatagtttgaagtcaggtagtgttatacctccagctttgttttttttttttttttgcttaggattgtcttggcaatgcgggctcttttttgattccatatgaactttaaagtagttttttccaattctgtgaagaaagttattggtagcttgatggggatggcattgaatctataaattaccttgggcagtatggccattttcactatattgattcttcctatccatgagcacggaatgttcttctatgtgttttgtgtcctcttttatttcgttgagcagtggcttgtagttctccttgaagaggtcattcacatcccttttaagttggattcctaggtattttattcactttgactttatctgtgaagtgtatttaaattctcattctatagaagaaaaatccaaagtacttggaaaagagaaatcttgccatgagatacacagttcttcagtttcaaagcagagattatctctcagatattctggctcatacaattttcagtacactgcaagacagaagatgtgaagacaacactacccaattggccttacacttgctttgctcgctgttaactaagttcactgtaaaaaaaaaatgattacaataaaacacattgtcaatgaactgtcacaaataaatacatctttagaaccacatccaaaatccagacatagaacatttctatagctccaaaacattttgacccactcttttggaatcaacttgctttctgcctcacagatcagggaattttgatctgcttcttgtcagtacagatttcattttccttgtaagagtttcacataaatgaaacataggatgcgctcttttgtgtctggtgacttttgtgcagcatgactctttctcagattcattcagatgtcctgtgttctaattatgtgctcctctttatttttgagtattatttaactgttcagtaattttatgatggatcccttcatctattgattgccgtgtgggttgtttccattttgggctattatggataaagttgctgtgaatgttcttgaacaagactttgcatgaacatatgtcttcatttcttttgggctaatacctaggcgtgtagttgctgtgtttatcagtaagtgtttaatactctgtccgactttacccaaagtggctataatattttacatgtccaccaataacttattatagctccacaccctccaaaatatttcaattttttttaagatttcacctaattgttactcaacagtaaccagaatagctagtgattattaagctatgtttttcttcccattttcttgtcaatttggggaattgatgtgttacaggacattgagaacagaatcaatactgtcctagttccctatcaaacacttttatcaagccataatgtttaggatggtaacatgatatataaagggagtgttggagtagtaataagtattttcaatacttattatattccataaagcaatatatcttcaatgaaatggcatttaactagacttagcatagtaaggttctcatatcaaccctagtattcagtattagcaaaagtttgaggaaaaaaatatccagcaacataagccagagagtgttttgctagtcaagtagcactgcaatactgatgctcttctaatgccagcccttcacaataatttccactcagaacatttggttgcctccttgccttgttctccttatgggacttcatgctgagggcatgtggcatcacagagggagcagtgcacttgggtgcagaaatatagcttagtagattgtctggccttagaggtggctgcaatggaatacacattttcaaggaaattccctgttaaacctcctggtaaactgatagttaagaccaggtgcggggacttatccccgttatcctagatgtttgcaagatcaagtagggagggtagcagaaatctaggagttcaagaccagcttggaaaacatagggagaccccctcatctctagaaaaaaaacactgtttgttaagatgtggtgtgaacaatggcatctctaagtgattatttattaacatttgctgagaaaattagaaaatagaacgatgccttctgatccaataatatcataataaagatgtgaagtttttaaactatggtaagtatagagaacataaaattgcccatcttagccattttcaagtgtacaggacaatggcattaagtatagtcacattgttgggctagcatcagtaatatccatctccagaactctttccatcttccagaactgaaactccatagccattaaatgacaaccccctccccgtttcccctgctcccagtccctggcaacctgtaatcaagttctgtctctatgacagtgactgctgtgaagcaggtttgctgtgccctggttaccaacctgtcagagtccagggagacagaacaatcatacacaacaagttacaagaatctagtttagtatttacaggtggccagcaaggcacggcagaagctgaggatttattgtgggtctttaccctgaggcacaggtaagtggggctgatggaatcttgactgtgtgtacccctcttggaccagagctaaggaaccccagaaagaagatgctctgggttttaaaccctggtgtcacaggacacatggagctaaagtactggaggacttaagtacaggaggacagtactagagggagctggatcagaagccagtctgttctgacctgtccctcgctatttcagaatgttacatttccagcacattctacaattattcttgagaagtgtaagaaagagagtggggaaaatcaagtgagtccaggaccatcggaggactggagtgaagtcgtcccccaacacagacatcccccgtagaaagctattccattttatatgcctaccaaccaccgtgaactggaggcagaggtgtgtcttgtcagagggatgaagcaccttgactgacacaatctcaaagcaacatcattgagacagagccagaaaagatttcactgggccaatgaaaactactaccagaggcagaatgatcaggcccacctgaagcagttatgtagcccaggatcccatgatccacagaagaagttgctaaaggggtgaaagaagaatccttcaggtgggattttctgaatctgcagaatccattttctgcaattatgagcttgtttccagatctcctctacttgaatttctaggatacctgaggtgtttatccaggtatagcagggggtattggaaattgtatacattcctcccagttgggattttttaaaggtctagagcaacactgttatcttaaacatccatcccaatggagttaagggatgtctgctgggttaccaaggcagtggctatggaggaggagcaatatctgccatggtcagggacaagttccttatcatttcactttttttcatgagcactgactcctatacgtagtaccaaaaatatcataaaagacataaacctatcatctgttgtaccttctggtaggtccctagtaagtctgaggtacagctttgggcttcaggctctatgatttacctaattccaaggaacaatatccagagacaaccccagcatgcccaacatgcaggatctcactattccacagatatccagagatggcatcacatatcctgcattttggtcactcccaaaccgcttacagagaaagatgtagcccttggtgcatacagccccccttttcccatttttcttcaatcactcagtcatggttatgctggtattggtgcgttcattagccaagtctcactgatagtagagttgtgtgagcaaagttttgctcatacaatattgtctgtagacagagggctagcattagtccagtccttgtttttatcattgccattgggatgtttctcatctatgcaatcaaaaaagtatggtgcatcaaaatattagtccaccaatgttttttttagttgtggtcatgacattcgccagaggcaattaagttaaacaggggtcctccagtttcctcccatgtggcaggtgtcagattctcacttcgtgggccagtgcttgggtccttttgatgtacaccttagtattaggaatgttggtgtaatttacccttggtggaatgaaagggaacctctagttaatgacagaatgaggtcaagaatgggagattcactattttgaaagatcaccctggtgacctaaaagaagctaacaaagacattgtgcttctaggcctttgctgcctcattcttgtcaaaatgcagcctcacaggttaatgcatcatctctcacccatcccagggtctcaggtgtcccctacccatctacaagggttgggccatgttggtgtaggaatgcggtctggctgtccttgctctgtgaacaatccattgcctttgtcacttgatccagatatttcagtcctgattgtccactccaggaagggagattctgccctataaaaactggtcatatttcataatatcaccaacactaaagggaggataagatgtccctggcaccagaagagggcccctagctccatgatatttcttagtcttgttatccatcactgtgggatcttgtagaaaggaagcacccagaggaaacataatcctcctattagagttagggggcctgtctggggcattgtaatggcctagattgcaaaccaccccagagcatatattctaaaggaaaaaaagaaaaggaatggttaggaacactgaaatagctttcacaggtccagactaatataagtgtctgcctggcctacctttacttccacccagctctgtgtttctcaacatgcactatttccctttttgtggcccaggatccttaatgtacatatttctctagtcagatgggataccaccccattaacagactttgtagatgtcctttctgcatattgctgtgtgattccactgatctagcattcactaggatcattggcctgtggatgcagggtgcatggaaagttcatcgtgttccatgagagtgtgcctattgtcatgttgcttgggcagtgaaagatgctcctttgtgagtgagaagtctcatggagtatccaaaaatatgacataaattgcactcaagggttacctaggtagtcccagcatcaaattgagcatcatatttctttttcctgcaggtggaaagctgtggccatagtcctttccttcacactggggattctttaatagtccagtctctcagttgccattttcctgaacagatggcaaggctgttggcaatggccgaggatttagtggatatgtggcatggtgcgttgttgggacagcctgcatggccattaccactgaatgtagttttgcccactgggtagaaagcccatgttaagtttcagttaaaaaagtggccatccactggctgaatggtggccacacctagtggacctgtcagttagcgttttgctcagccttcagtgactcctgccatatggaaatctctgaatcttgggctccacatgggcaaataaagagccaaattatcacctacaagttatttggtcccttctagcaagctccccatttgttcatggagccacagatcctgtggggtcctgactaaacctgatcaagaatgtgccatttccatttgataacatggctctgttcagattgttcagttttactaatggtgtttgtaagtatccaagtgggaatggacagctaagggaccagtgtcacagtcacacatggtgctgaagccttaacatgttcagtctccatcagtgcctaatagcaagcaaggagttgccattcaatataaacacattcagtggctgattcaggcaacttatgtgtcctaagattgagaggctggtgcactcattgatagttttctgttgctatacgctccactgagtatgcatagaggttgtggatacctggacttccatctggttagcaggctgtaaaaatcttagagaagtgactgggccaggccttgttgaacagattccaaggcaactgttgcaaaacgcctttttcaaagttggcaactttgttcatgattttgactaagggaaccaaaagaacacccaggtgaggtttatgccgtctcccattcgcaaaggggcctacctgccactgagtctccttttattcagtgggtgccacagcgaccaatgtttccagctgttcagttggcataataattaactatgagtacacagctcactttcactatacatatattccttgatggaagttacagcatcatacatgattagcgtgtcagaaccttcaccacatctgacagggtatcaattcaattacctagggtttgtgtgtcagttttgcttgactaacaatacgttttctcctttctatagagacggctgcacctgtgcaggtgataagatcatgaactgcaccctttgccttacttttttgttgtaaataatttgcctgattcaatgccatattatggaagaatttcttaactgtgatgaaagcacttggaaaatcctcaaataatatttcatgcagacatataactgaaagaaagacaaatgcatatacaggaaaacaactgctgctcttctcatgttggatgaggcctgctaaaaacacctgacaccagctgttagtctgatccttgatgtctggtacaatcttgggttattctccttggaaaagtggatgctcagaagtgccagtatccccgtgagtcccagttaactgaaattcatattgttaagcccatgcatggatagtcatgacatcagttcatgagattccctgggaaagctgggaaaggtaactgatgaagtccatgttttgaattattttaattattttgagctcctgcttctaatggcctttagataaatattcacttggaaaggatttattttttctactggtccttttttggaaggtccagtcatatctcctccagagtgactttgtgtccaatccttcagatgtgtttcttctaaggcctgatgatctgtcaaaaccactagtcaagattgtgatattgttggtaatatccagagcggggagaggacaatagtactcccaatattgcgggaggtgtacacccctctttgtgttattgttcttaatatccagggggaaaacaggatgacattactaccaatatcgtggggggtttacacccccccttgtgagattcttcataatatccggcaggggggtggataggactatattattcccaatatcgtggggggtgtacacccctcttgtgatattattcataatatcctggggggagacgacaatattactcccaatatcgtggggggtgtacaccccttattttgatattgttcgtaatatccagggttggagaggacgccattacccccagtattgcggggagtgtacaacccccttgtgatattgttcgtaatatccagggagagaggaagatattactcccaatatcgtggggagtgtacacccccaacttgtgatattgttcataatatccaggaggggagaggacgatattactcccaatatcgcccgggctgtacacgcccccttgtgatattgttcgtaatatccgtgggggaagggaagatgatattacttccaaaatcgtaaacactttgtgtgtacacccccctgtgatattgttcgtaatattcggggtgggggggagaggatgacgttactttaaatatcgtaaacacgttgtgtgtacacccccccaccccacgatattgttcataatatccagggagagagaggagatattactttcgatatcgtaaacacgttgtgtgtacacccccctgtgatattgttcgtaatatccgggagaggagagtatgatattactcccagtatcacggagggtgtacaccccccgtgatattgttcataatgtccagtgggggagaggagatgtattactttcaatatcgtaagtaacttgtgtgtacaccctcctttggtattgtccataatatccagggtgggagaggatgatattactggcaatatctcggtggctttacacacccctgtaatattgttcgttaaggagttaagaggatgatattactcccagtatcgcgggggcgtgcacgcctctgtgatattgttcataacatcttgggagagacaggaggaaattactctgaacatcgcggggcatgcacagccccctgtgatactgttcgcaatatccagcggggaataggatgacattactcccaatatcgctggggatgttcaccccactgtaatatttttcttaatattcgggggggaaggatgatattaatcataacactgcggggggtgtacacccttctgtgatattgttcattgtatccagggatggttggagatgatattactttcaatatcgtaaacaccttgtgtgtacacccccctgtgatattgttcgtaatatccagtgggggaaaggataatattactcccaacatctcgggaagtgtacacgtccctgtgatatttttcttaatatccaggggggcagaggatgatattactcccaattttgcggggggtgtacaacccactgtgatattgtcgtaatatgaagtgggagagaggatgatgttactcccaatatcgccgggagtgtacacccccctgtgatattgtttgtaatatccagggggggattggagatgatgttagtttcaatatcgttgacaccttgtgtgtacacccgcctgtgatattgttcgtaatattcagagggggagaggatgataatactcccaatattgtggggggtgtacaccaccatgtgatattgttcataatatccagagaggggagaggatgatattatgcccaatatcgtggggggtgtgccccccctgtgatattcttggtaataatcggggggagatgacattatttccaatattgtggggaatgtacacccccttttgatattgtttgtaacatttggaggggagaggatgacattactcccaatatagtggggggtgtaaaatccccctgtgatattgtttttaatatccggggggatttgagatgatattactttaaacatcgtaaacaccttttgtgtacacccccctgtaatatcgttcataatatccaggtggggagaggatgatattacgcccaataccacggggttgtacatacccctgtgacattgttcctaatatccaggggaggaggggatgatattattcccaatatctcagggagtgtacacctccctgtgatattgttcataatatccaggggtgattggagatgatattactttcaatatcataaactttttgtgtatacacgcccctgtcctattgtttgtaatatccaggaggggagagtatgatattactcccaatattgtggggggtgtacaccctcttgtgacattttttgtaatatctgggagggagaggattatcttactcctagtatcgcaggtggcgtactccccgccatgagattgtttgtaatacacagggctgtcaggatgatattactcccaatatctcggcattgtaccctgccccagcatgatgttgttgttcgtaatacccaggcagggagaggatgatataactcctaatatcacatgcagtgtaccccctctgtaatattgtttgtaataccctgtggtggagaagataatattattctccatatcacgggtgatttactcctcttttgtgatattgttcatagtaccctgtggtggagaggatgaaattgctcccaatatcaccaccgatgtgacattgttcataatactcagggcaagtctttcctgtgtttgtcccatgatagggaataagtctcttgagatctgatggttttatgaagaggagttctgcacaagctgtctctctttgccttttgccatccacgtaagttgtgtcttgctactttttgccttctgccatgaccgtgaggcctccccagccatatggaagtgtaacttaattaaacctctttttttttttttggtaaattgcccagtcttggatatgtctttattagaagcatgaaaatgggcaaatacagtcaattggcaccaggagagtgggccgctattgaaaagatacccaaaaatgtggaaatgactttggagctgggtaacaggcagaggttggaacagtttggagggctcagaagaagacaggaaaatgtgggaaagtttgaaactccctaaagagttgttaaatggctttgaccaaaatgctgataatgatatggacaatgaaatccaggctgaggtgttctcagatgaagatgaggaacttgttgggagctggagtaaaggttattcttgttatgttttagcaaagagattggtggcattttgctcctgccctacagattggtggaactttgaatttgagagagatgatttagggtatctggtgggagaaagttctaagcagcaaagcattcaagaaatgactcaggtgcttttaaaggcattcagttacataagataagcagagcataaatgtccagacaatttgcagcctgccaatgtgatagaaaaggaaatcccatttctgaggagaaattcaggccagcagcagaaatttaaaaaagtaatgaggagcccagtgttgttaatcctcaagacaatggggaaaatgtctccagggcatgtcagaggtcttcatggctgcccctcccatcacaggcccagaggcctgggaggaaaaagtggttttgtgatccaggcccagggccttcatgctgtgtgcagactaaggacttgttggcctgtgtcccagctcttccagccatggccaaaaggggccaatgtagagctcaggctgtggcttcagaggacccaagccttggcagcttccacgtggtattgagcctgcaagtgcacagaagtcaagaattggggttgggaaaccttcgcctagatttcagaggatgtatggaaacacctggatgcccaggcaagaagtttgctgcaggggtggggtgcccatggagagcctctgctagggcagtgctgaagggaaatgtggggttggagcccccacactgagcccctactggggcactgcttagtggagctgtgagaagaggggcactgtcctccagatcccagaatggtagatccactgacagcttacaccgttcacctggaaaagccacagatgctcaacgccagcccttgcaagcagccaggagggaggctgtactctgcaaacctacagggacagagttagtcaagtccacggaaactcacttcttgaatcagcgcgacctggatatgagacatggagtcaaaggagaccattttggaactttaggtttaactgccctcctggatttcagacttgtctggggtctgtagtccctttgttttggccaatttctcccatttggaacagctgtattaacccaatgcctgtacccacaattgggcctaggaagtaactatcattcttttggtcttacaggctcataggttgaagggtcttaccttgtctcagataagactttggactgtgaacttttgagttaatgttgagatgagttgagactatgggggactgctggaaaggcatgattggttttgaaatgtgaggacatgatatttgtgaggggccaggggcagagtgatatggtttggctgtgtccccaaccaaatcccatcttgaattctcacaggttgtgggaggtacccggtggttggtaattgaatcatgagagcaggtcttctctatgctgttctcatgatagtgagtaagtctcatgagatctgatggttttataaagaggagttcccctgcacaagctctctctctttgcctgccaccatccacgttaagatgtgacttgctcctccttctgccatggttgagaggcacccccagcttatggaatcgtaagtccattaaacctctttttttgtaaatttcccagtctcaggtatgtctgtttcagcagggtgaaaacagactaatacaggattcagacagatttagaattttaatggcttcttgatggatttaccaatttataattataaaatgtccattttatctcttgcattaaagtcatgacctagtttcttttgctcagttttacatgatatgtacttttcatcctttcattttcaaagccattctatattcttactatagtgtgtatttaatgattaacatacatctttgattttaatcctgtctgataattttatgatttacttggaaaaatttgtttatttacgatgcaattattgtaaagttagggttaaacctaccgtcatgtttcctctgattttcttgattcatgctttcatttgaattagtttaattatagattttttcttatattaacttgctaaatatgcaagattattatacagaagatatcctcaacttattaatgcctaatacacatatagtgtattaaaatttctctctcaaattatttctaggtaagtgacacaagcagaatcaacctttggaagatcatctatttcctgctgggttgactggaatgtgtgatacgacctaaggtaacctttgagtcaccacacagacctagagctctgtgtgatgcagcacttcctcaggagcttgcagtggcgtcagggcccagccttgaatgccaggcaggggtctctcaactctgtgattcttcccaggaaatacataagaacttgcatctgggttcatatctcaaacgcaacccaccagtctctcacgtactgacctctgctctaagtcttcagatggttatttttcatgcggtaaaaatatggcttacatattatcttgtaattctgtttaagatggcatacttatgttcctttattctttcaaacttggtccttattgttgaaacccagctttggagttcagaaaactactttttacttcaacatgctgtggttgagactgtggaaagacttttggcactaggtctttagttttgcatacatttgcagcaacatatctagtaacttaaaaatctagaccgtgaagagttatattttggtactccctgaaaaaagtaggaaaaaatacagtgcctgctggtgtcctggtcaggggtctgccttcggaaaagtggtggggggaggtggaggaggggagggaaactgttttaatattaccaaaccttatcaacatacatatactctagtaactgctaaaccaaatcaaaagaatgtattagttttgcgttgccagtagtcagtctcaattaggtgcctgttacgcagaacgaatttacttgatgaatgaatgtagggaaggaagagaggcttagaatgagctttcattgagctttctcttctcttgtgtctcattgctcaaaggggaggtgttcctcctcctttttgcagactctgtcatgcaaaggctgctgcagctgatgggaacttaaaatgtggtgcctgaggtgtagctgagaaatttatggtcatgagccctcagctgtaccaagtcctctgagttctccaacatcttggtctttaggcatctaagagaatccacagtgcctgctctccacagaaacaacacatctgggcagctaggccacagcaagcagggaggtttgtgttcaggactgtaccattgtgggagaataatgtgtactttgctggcagcaataaaccccaacatcctcagcatccatcctccttattttaaacatgaaatctgtccccgacccactgccactgaacctgtctgggactccagggtccctgttggaaaccaaatcaatcaggagccgtggaggctggcctggcttctgtaggtcccaattcaaataggtgtatccattactgtgaaaggggctatgactggatctacaggagatagaggctggctttccaggggtgatgggcagggagagtggaggctggttcacacagcatctccattggatcctgaaataataagagagaagtgcaaggttatgtacaaacattgtgagccattttaataattttctgtctgttatttatgttttgctcaattattttttgtgtatgattttggttaatactcccaaaacatacaggtttaaaaagaaccaagatttgcaaagcacaaataagcctctagaaatcacctatcccatccccctctttctgtgtcacagctttcactaaagtacatgtccttgctccttctggaatcttcctcactctcacagatctagacatcacatgccccatcctggaggacaagacacatctaacacgaggacagaacacacatgggaggtggcagggcccacagagttcaccctcccaccccatcatcctccctcatttcccttctgctctcagcagggacccagtgcattagcagcccagggagctgagcagggagcctcactgtgggaaggtgaactgaggagtcctgatcagtcaaggcaaggttagagctgagcttttatctcagactcacaagggaaggtcttccctaggggacagcatgcaaatcccctggtgggtgcagtggggtggaaagagccaaggagaaggtggggacctctcttgtgagcaaaatgacataaatatattttatgtttttaaggatatcaagagaggtaaaatctgtttcctgagtggcagaagggacatatttagatgtttcctgctatttcctctacccaatttctagttcgttaggactttctcaggcatgttttacacttctctttaataaggttgagctttcataaatatttggtgattcttatttcttggttcaggcttatttaaaagagcctaggtttgttttattttattttatttaaggaaaaacacacagtgcaaaaggttcaaatcttaagggtgcaaatgaatgtcgaaatccagatcatttcatgtcatgatccacatcaaaatatggaaggtttccaattctcttgctgctttcattatgcaccttcccagtcagcaactgctgctcaaaacacaatcaatgtaactgatactgtgacatctattataattgttttttttcctgtacttaatcttcatatcaggtaaacattttttgtagcttctttcttatttctttcattttttgagggcttgattccttcttatcaatttgaattgctgtctgctctcattccctgttattctgaaggattttctcttgaattttccacaaggcacatatgctataatgaattagtctttgtgtatgaaggaacatttctaccttgcttttacgtttaaatgattgttttgctggatatagcatttgtggctgacttttctccccagcatttaaatatatcattccactctcatcccacctctattagtaatgatgaaaatttagccaatacctttattattgcttcctagtatagagtaagtcagtattttagtgatgccttccaaattctctgtgtctttgtctttcaacattggtatgtgtattgttatgaattgtattgtgcttatcctagaagggtttcactgagttactttcatgtacagactaatgtgtttcatcattgtgaaaaatgtttttcattatttctccatttttttctttttcagtttttattttagaatcaaaccatacatgtacagatatgttacaaagttattttgcatgatgctgaggtttggggtatgacagaaattattaaccagttagtgaacattgtacccataggtagtttttcagcccctgccctttctccctttgtgttccttctagcacaatgtctattgtgcccatcaaccagggattcaataaagaaactgtggtatatatgcaccatggaatactatgcagccataaataagaacaaaatcttgcccttgcagaaacttggatgcagctggaggccattttcctaagtgaacagatgcagaaacaaaaaaccaaaaaccacatgttctcacttataagtgggagctaaacatggggtattcatgggcataaagatgggaacacatttttagcctctttctgtcttctcctttgtgattcctaatacaaatttgttggtattatacacatggacctatgatgtctgaggttttattcattcttctttataattttttccttctttatatgagatcatttctattgacttgtttttcagttcactgattcttgtgtcatcttaaattgctattgagtctatctaatacatttttcaattgagttgttgtacttttcatttctagatttcccagtatgcttgttttcatagttttgtctctgtttgagagcctctattggttgaatcattgtctttacaaattcctttttcagtcttttattataggttaaaataattctttgaacatatatttgataagggtggagcacatagacaccatggagatggaccataaggcagggagctccgaattagattaggtgaattttgagtctctgactatatgatgctcttgtgggttttaattatttcccatgttttatgtttctcatattacaaatagcttttatttttaagatagtaactattatagaaattcagcttataaattcctggaaatttctaacagaaagattgatgaaaagatggtttttttaggcccccacaccagcctctgcctgggacctgactttgtctctgagccagtggaatctgtgatgaggttttgagttgggcagtgaaatcaccacagggaaggctgtgctctgggtgctttggatgacaggaggacactccttcagggtcagtgatgctgggagttcaaagggagactcagcatggagctgcctgtgagttatcccagcaatcctgtttggacagtgatcatctcacaagtgtgctcggaagccactggatggccaaaatgtgggctcaggttggagaaggacaaagctatagggatgaaaatataagactcatttgatactctgaaatatcagtacaaccatcatgaattatatgggaagagaaaggagtcacaagattgtgattttttatttgatattaaaatatgtcacctctgctcatttttccctcaatgatgtacctactgatatacatttaaccaaagtcactgtttttaattttcattttagtaactgatagcctgtgtgcagagttcctaaataacgaagccagaccatcattgctatgggtgaagccaggaagtgactgtggatgtgaacaaatgtgagattcatgtacacgtctccaaagacagaggccactgatctggggagaacctgcagtcatttcactttcccatacccagatgagaggacaccttgatctgtgttcatctgatgaactctaaaatctggaccatattctgaaggtgtagttcacacttcttttctgtgctagtgggactctctcactgacgtgtattgtaccctctgcataggacagtctgtgatacatactacttgttttctgctaaacacccatcaatcatgtcatttatgagtcttccataggtgttacctaacctatggctatggggtcttccaaaagaatgggccagaggtggagctgtgaaactgtagctggataaaaagtgtaaatgtcaagaaagggtattgaagtggtgataataataataataatccaaattagtctgggctcttggctgtgattactggtaaatgtgaaagagtctaggtttggtttttattagttttatttcaactgataaagtagccagagtaaagtgcataaatcttgaatgttcaactgaatacagtttttgtgtaattcattgtccgaatggaatgatagaatatttcacattcccttgtgcttccctcatggacaatctttgtcagttatcacccctctcacccagcaaaattaatgtctttctgacatctatacaatcatttaggttttcctgtcttaaactttatataaatagcattaagtgtatttttatctttttagacttggtattgctccttacaacttttgaggccttcatttctttcagaggattcaaggtcctgtctcatgtcatttcctgtgattctgaaggattttctctcaaatgtcttgtaagagacatagctgctatgaatgaatgtattttgtttatcaaagaatttttttgctttttctttagatttgaagggtattttcgatggatatagatttcctggttgcctttttttttcctttcagcatttaaatatgacatttcactccttctagcctctattggtcctgatgaaaactcggccaatggctatgttgttgtttttctgtatatagtgtctgctttcattcttgatgcaatgaagattttctctttgtctttcaatattttaatataatgtgttcagttattaattcctattgattatctaaaagatttttattgaattttttcatctaagaattttttattacttttgaaaagtttttgtcattatttctccaaagatttcttcagccactttctctttctctcctcctttgtgactcttattatacatttgttggtattcttcactctgagctataaatctctgaagtcttcttttttttctaaactttttctttagactcaataatttctatacctctattttcaagttaactgattgttctgccatctcaatttgctattagacctagctaacaaatatttaaattggtttattgcacttttcatttctagagttccaatttggtcatttttttatattttccatgtcttttcttgaggccctacttgccgaatcttctttttttttaatattttcttttttatgtcaatgatcatagatttaaacataattatttgaacatctgcatattaactgctttgtagtctttgctaaatccaataattggggcaagttagaattagctttcattgactattttctgttgttattattgtagctgctttatttttattcctttaatattgttcatacttctctgcttttttccagaagttgttaaactaaaaattgtacatttttgatagcatattatagtagctgtctttagattttgggcttttttattttaattttaacttttttagaaatagggtcttactttttcacccaggctggagtgtggtgctgtgaccatagcttgctgcagcctcaacctctgggggtccaggggttctgcagcttcatcctcctgagtagctgggactataggggcatgccaccactctctgttattttttttttaattgtaagataagagtgtcactattttgcccacccagcctggtctcgaactcctggcatcaagtaatccttctgcatcagcctcccaaagtactgggattacaagcttgagccaccatgtcaggcctggaatttgttttgtttttctgatcattttttaattttcttcttagtttcttgtctgaacttactgatagtacctgacttatgacagttggagttataatgttttgactttcagatggtgtgaatgtgatatgcattcaagtagaaatagaaattctagtatttacacaactattctattttctctttcaatatagtattcaataaattacatgaggtattcaacactttattgtaagataagctttgtgtaagataatgttgaccaacagtaagctaatgtaagtgttctgagcatatttaggataggataggctgaggcataatgttaagtggattagatgtattaaatatattttcaatgcaagatatagaaaagtctgtatctcatgtggcgtttgaccacagatatctctgcttctttctgttcttaatattaatatttagtttgattttataggaactacacatgtatctgcatagcgaagtggtcaccaatgatctgagacattttgctcaaatatctggaggttataaatctatcttctgtcaacccatctgtgtgtagtttaaaaagcaaactgcatgcaaaatgcagctagttcttacctccctctggttttactttgcaccggaaactcctagttctcatcactcatatctataacttctaggtcactaggaatatgtgcagagattatttcagcaatgtgggtctatcttatccaggaatctgctatttactatcagcagatgtactacttgcctcaaacaaggcatcatcttggactagcaaggctgtgggctttttctgttcatttcctatggtgttctccctgtttagctggaaacactgaagaattatttcccactccttggctttactcaagtccacccactttggcagcaagctgccagttttatttgctatccttacatgggtaaaactccagttctgcaattcatattgactgagctgggaatagaagggtgctgtcacaggcaaaaggctacagacattttctgtccttactcaaagcactagtactttttttttctataaaaaatatgcatccttaattattttatgctttgccaattttcagagtgctgaaatagttttgatatttcagctttatatttataggtgtgtttgttgtttattcttgcacagatttattaaactctttgtgatgccataaacagagatgccttctgaaatgcgtttaaatgaatgtaatagccacactgaaatggtatgatgtaatggaataacataagtaattttggacttgagaacttgagctccaaaatggccaaatagagcagagatgctaaaactgagtggccaccacactagctgtctgtaaaggaagcagctggtataatctagtaaacactgatggtcttcttgaggtttttgtttcatgttgaatcactgtgggaggccagttattatactgctgacagtaataaactgcaaaatcttcagactgcaggctgctgatggtgagagtgaactctgtcccagacccactgccactgaacctggctgggatgccagtggccctggtggatgcaccatagatgaggagcctgggagcctggccaggtttctgctggtaccaggctaagttgctgctaacactctgactggccctgcaggagagggtggctctttcccctggagacacagacagggtggctggagactgcgtcatcactatttctccagtggtatctgaaattggaaataaaacagaaatgcactcatgtaatcaaaatcaaacccactgtctttaagtagagccaaaattgttgatctacattgaattttaattatatttcttgctgagcagaggtggcaggagttttcactgatgtgcaaaaccacctcatattcccctcacctgggagccagagtagcaggaggaagagaagctgcgctggggcttccatggttccgtctgggtcctaactgagcagttcctccccagagctctgacccaggcattgatatgggccctggaaggtagggcagctgggagggacatgcaaagcagctggggtgggagctgagcttccagatgcaaagaccacctgcttcttcctctctgcactgagcatcctgcgccgccctggttgtcaggtcagaaaagtctgttggctcagtctgagtgtagaactcctcccttgtgctcagagaatttcgctcctgtgtctttcttctcctcaatcacctaaatccacccagaagatgtttggcacaagcctgttaagaacaatataaaaagctgtgttttcacttctctcttcctatcctcaatatgcccagtcatctccctaagtgcattattggatcgatggaaatgaagagtctgttagaacttaatcttccagatacacctttcatttgcttgttagtaatgttttctgagggtcctgaagctttccattaacccagccacataccctctttgagttaaaaagtgaaaaacttctgtttacagtcacatgtcctggcagccctgacatagatgctccatggcttgccgattgcttgaaattgatcaagtaacttaacttccctgtgtctcggtttccatatctgtgtaactgtgacaatactggtacctaccttatagtgctgtagacagtttaaagaaaataagataaaacatttacaatagtattcaggacattatgtatgtggcaattaattttgtttttatttattaaatatttagcactacagtcatcatcattatcataaatatacttacttagcacagaaaagagtcttcagtctaatccaagaatgttttatccacagccaaatttaattctaaggcttttccttcactaactctacacaactctttaaatcctaatgatttggtcttaatctgtgctaaagtactcacaccttcaatcattcccacccatccctgtctaacgcattaattctcatcatccattatcaaaatgttactctataaaaggttcccatgtcctgttgctgtccttctttcttacacaatctttattctaccctgttatcttttgtcttattgttgccccaggacaataaggaaaagctaccatcattacctgttgacttgctccagtataattttttcaggcttgttaccttggaaatgaggactatgtctggcaaagaaacatattcatctggtcaatgtgttatgaaataaaagattttatctacttatggtccaataagtaatttagacctacttgaacagtttttttttaatgaacgaagaagaagatgatataagaggaaaatacaatacaatagaaaacacaagctattataactcttgcttcacggatttctacatatatattagacatatgctgggtatatgtgtgcaatggtgatccaaaaactgaacgctaactggctgaaggaaagcctgtattacattgggtcttgtctatttttccaattatgaacagaaagctacagtactatttgtatgagtatcaaaccttctagctgctgtgatggaggtagagaagatttactgagactaaagccttggaagtactagaggtttgtcctgtgatgttatgggtgttgctgtggttgttgttgttaggaaatacagtggaagtgaaagcaagtagaaaatttacaagctctgctcttcctcatactcacaaccccttctagagatgacagatagtggcacaggaatctctgacacctctaaggaagtcttttttgctctttccaggatctttcctgacaagtattgttttgagtcacagatgatgtggaagtaggtgtagaagaaaggactagagcaagggaagaagctttcaatcccaggtagtggttgtaggcacagtgaaatggaatttttcatagatttatgctacacttctatcatgttggggagagaggcatcaaaccaagcttattcttgaaagaaacattacattattttaaagagaaggaactatgcatttcttgtcaaatagatgtttaaaattcaaagctacaattttttttttttttttgacagtatcttgctctgtcgcccaggctgtagtgcagtggtgcgatcttggctcactgtaacctccatctccgtggttcaagtggttctcctgccttagcctcccaagtagatgggattacaggcatgtgccaccacacccggctaataacaggagggagtaaagggccacacaagcatgtacacaagagacaacttttcttcttttttacagaataagtctaaatgtaaaatagcgttataatgtatggactcatgtttaagacaagtctcttggttttctaatttgtgttgaacccaagcagtgttgtgatagaaaatgagtttctttttctttaagctgaatttgaatttgctccaatagcctaatagacaccctagtggcaagtcctctgtgatgctcgccattgtccccatgtctaacaaggatttctactggacacagaagtttttctaagtccaacaagagggaaagagactgggccatcattgttctcatctcagatttccacttcctgcatagaaggtatacatataggtagccagacgttatgaaaatggattgtaagcatttgttagtgaacaaaatatgactcaaacagtatttttattttttatttttaaatttctattgcttattatttgagacagactgtcactctgtcacccaggcaggagtgcagtgggtgcaatcttggctcactgcaacattcgcctcctgggttccagtgattctcaggcctcagccacccaagtagctgggattacaggtgtgtgtcactacgtccagctcattttttttttttttttgtatttttagtagagacagggttgcactgtgttggtcaggctggtcttcctgacgtgaaatgatccatccatcttgacctccaaaagtgctgggattacaggcgtgagccaccgcactgggatttaagcaatatttttattaagtaaagtgtagaagaaaaagtgtaagtaaggtgacaataagaaaacaaaatgccgtaatggaaaacgataactttagggcagaaaacaagaaaaggcaaaccaagattcctgtagggcaagcctccaatgcacaatccaaggaggaatgtcaagggtgaaaactctggagcatccagatagtggcccaaaataccaaatgctgaaaacccagaatacccaagtaacagcctatgagtgtccccacaccaaatgccaggaaaccctggagtatccaggggctgaccagtgcagaaaatcctggagcctcagtggggtggccaacaatgagccccaaaggcctggttggggccatagaacaatgtgactctggcttcttagagtcaacagaacaggagaattcttacatccaagtgtcctgccttaaacaattgcacaaacataattagcatggacccaaagaaaaaactgcaaagcaaacacatatatcggggcagaaaataaaataaaatggctgatggataaataaaatggcattagaggagaaatgactaagagaaagaacaatgaggatgtagtcaggtgtgctatgggggacttcaaatggactatctagccaaaggccttatttcctggatcatctgatataggcaggtgggtagatgggacacttacaggtgtgcaggaaccaaaatggggccaagcagtgtctgacatggggcctgcatgaagatctctccaggcttcccagctcgggtgggttgggctcctatgggggaactggagcacggagcggctggcctgcatgaagcagtggctctgtggcctcttgcccatccccagggctccaccacctgtcaggaaagatgatggttcttaaaacagtctttggctagtgttaatagctctgcaatgttagcaactctgtagctttgatcgctgtagcgcatatcagcgtctcatcctctctcactgatcgctgtcttgccacttctccaatagctgtcttgcccattgctgatcactgtgtccatcttctcataaagtgccatctcttgctgtctcttgctgtcttgcttctccgctgtttccactgtcttactgccacatcaaatgctgcttctcaccatctctagtggtgagtggctggctcaatactgatgcaaggcaagtcctcagctttgctcaggaaggaatgttaagagtaagccagtaatagaagaaaacagctttattgatggggcagcagtgttacagctctgtgactactcctgcggagcaggggtaattcataggcagagggccgagagtagcagccaggggcatttttacagtcacatttatacccacttttaatcatgtgataattaaggggtaggttgttcagaaatagctagaaaatgggtggtgttgccccaacttccaggtgttgctatggcaggggcaggaatttccaggtgttgccatggcaaggcgctgtgacttctggatgtttctatggcaatggtaaactctcatggcactggtgggtatgtcttatggagaggtcctttcagaaccctgttcctgttttggccagcctcacatctggtccagagcggagtcctgcctacctcttgcctcaaaagtaacaagaaatctgtaatgaaaatttacccagacagaaaactccaattttatatttggtagttagtgacatggtacttatcaaagttacacaaagattcaagtgaataaaaaatactctcagaattattataggaggtcataatgtcctgtagtccaaaaattaatatgcacataacaaaacaaagaaattaaaggctgatatccattgtgaatataaaaataaatatcttaagaataaaagaaaaatgcaatcccactgtatatctgcacatttagtgaacacacattgtaaaaagtgttacagtttttataaaaactcttgataggtaattttaatttctgaaaaatgtatatgaactataaggtatgttggatctcttcccctaacttaaaaaatatttcttcacatttaaattctttaccaatttttaatgactttttattgcttagaattttagttgatataaataaaaaatgtgtattaaaagcctaccattttgatttaacctatgaaatatatttaaattcttggaaaaatccaaaaatacctagaaaagtgagctcttgccagaagatacacagttctttagtgtcaggctgagattatctcccagaaataacttttggctcatatagcttccaggacactgcaagaataaaagatgtgaagacaatgttacttaattggatttgcaattattcactattcactgttaaccaattttattgaaaaaaaagattccaatcaaatacactgattttaagtgtactgttgggtttaataaataaatacattcttggaagcaaaatcaatacacacaacatttctgtacctccaaaaagttttgtcctgctcttcagcaatcaacttgcttccacctcacagaacagaccatccttattcagcttattgttagtatagattccactatctttttaagaatttcacataaaggaatatagcacatattcttttgtggctggtgactttcgtgcagcataattgtttcctaggctcattcatgtcgccttgtgtcctcgtgatgtgttactctttacttttgagtactatttaaatatgtagtaatttcacaatgtatcccatcacctgctgatgaccatgtgggttgtttccactttgggctattatggataaagctaccacgaatggcattatacaaggctttgcatgaatatttctttatttcttttaggcaaatacctaggagtgcagttactgggtcttacagtaagtgtttaatactctgtcatactgttttccaaagtggttataccattttacatctcagcccagaattgatgagaattctcaatgtttcagctacttgtttttaagactttttcttaatcatcactcaacagtgaccagaatggctaatgatcattaagtcatgttttccttacaatttccttgacttttgtgggtgcttgacttgtatcagaatattgaaaacaggatcaatattgtcttaacccccttttaaacactttttctaagtaatgatatttaggatgataacaggagatctaaagggaatattggtagtagtaacaggcattattcaatatttattatcatactccttaagacaatacattttgagtgaaatagcattcagctagactcgggataaaaaggttctaatctcagctttagcattaaatattaggaaacctttgagaaaacaatccaggaagacaaatcagagtgttttgctagtggagaagtgctgcaacacctaaaccctattaatgccagatctttgcagtgatttctactcataaagttgggttgactccttgccttgttctcctatgtgtctgtgtgactttatgctgaggggatgtgacatcacagagggagaagtgcacttgtgtacagaaacatggcttaggagattggctttggatgtggctgcaatgaaatatatattttgaagaagtcccctatgaaatgtcttatacattttttcttatggcagggtgctcgggctcacacctgtaatctcagcactttgagagaccaaggaggaaggatcacgtaaggccaagaacttgataccagcctgggcaacatagggagaccacatgtgtacacacacacacacacacacacacacacacacacacaatttgtgaacagtggcatcaagaagtgattatttatgaacattggctaagaaaattacaaaataaagcaatgtcttctgagctaacaatactataataaagatgtcaattatttaactgtagaaaatacagagaacatgaaattgtctatcttaaccatatttaaaagtgcagtgcagtggcattaagcatattcacatgttctgctattattaccgatactgtctccagaattcttttcgtcttataaaaactaatatctataccccttaaacaatactccccccatttcctgtatccttatccctagcaacctccattccagttctgcctctatgtcagtgacatctttgaagcaggttcactgtacactggttaccaacgtacctgagcgcgaggaacacaacacccccacacagcaagttacatgaagggggtttattattacagataagcagcaagggatcacaaaactcttggactcattatggatcagtcccccaaggcatgcgaaagttatgtggagctgatagagtcgactgtgtgtaccccgcttgcatcacagctcaggaacccggaaaagcagacactctgggttttatatcctggggtaatgagacgcacagggctaacgtgcttaagaacattccattctatgagaaactggaatacagcacaggtaggctgttctggccagttcctctctatctcaggatgttacaattccagcacattctacaattattcttgagaactcttaaaataatcaagaaagtggagagaactaagtcagcccagggtcattggagaactgtcttgcagttaccccaccacctagacatcccccttagtaaagctagcatatttcctatgcccaccaatttcccccaaactgaaggcagaggtttatctcttcagattgacgaagcaccttgatttacacaacctcagtgcagattattaagccatagtgagagtacatttcgctggtctaaggaagggtactaccactggcaggaggataagacccccgaaagcagtgacctagtctaggatcccatgatcaagaaattaagatgccaaagaggtgaaagggggatctttcagatgccccattgtctgcagccattgagcctgcatcaggatcacctctacttatatttctaggatacctgaggtgtttatccaggtacagaaggcagtgttgggtgttggtaattacatggaacatccgttatgttccacgagaatgtgcccattgtcacgctgattgggcagtgaggttgtttcttggtcagagtgaagtctcatggagtatccaaaatatgacataaattcctctcaagggtggccattgtagccccagcatctaatagagtgacatatatttagcagtccaggaagcaagctattgccatagtccttttctccacacaggggatcctttaatagttcagtcgctcagttgctgttttcctgaccagatgaatgggttgttgaaagtggcccatgatttaatggaaatggagcaaaatatagtgttaggggcagcctgcatggctgctatcattgcatgcagtttggcccattgggcagaatggccatgtttagtgtcaatcaaaagatgccatcccctggctggatggtggccacacccagtggacccactggcatgtgttttgtacaatcatcagggccccatgccatactgacataggcatgtctttgaatctttgactctatgtggccaaaggagaagctgaattgtcccctgtgggtcatttgttcccttcttgcaagcttgtcatttgtttatggggcacatgggtattgtggcatcctggttagggctgattctgactgtaacatttccatttagtaatttggatctgttgggcctgtccagttttattgattgtgtttgtaggcaccaaagtgagaatctgtagttaagatagcagtgtcactcctggtcctctagctctgagatactcaggccctatcagtttcctacagcaagtaaggagttgccattcaaaagaggcacaaatgatggctgcttcaggaaacatttgtctccaaaatctaagtctggtgcacccagtgacaattttacattgccacagactccagtcagcatgcctagaaatagtggacacctggatttacatagaacaagcaggctctaaaggtcttaaagaaatgccttggacatgtatagttgaatagattccaaggctaccgttgcaaagggctccattcaaagttgtcaaatttgttcatgcttttgactaaggtgaccaaaaaaaaaaaaaaaaaaaaaaaaaaaaaaaagactcagggggacagtgcagctacgtaagaatccagtggctttcccgagcttatttgtcttgcatttttggtgacatggattgttgttcatatcggcttcctctggcaggtccacctggaaagcattatatttagcaagaataaaggaggctgtgaatgatgtcactgcggactgcgtatattccctgttgcaaatgtcaaatccatgaagcaaaaagggatttactagaggttattaaattccttacaaattgttgaaaagccttaaaaaacaggctccagtcaaagcctctagaacaattccaagaatcgtactgctggcacaggtcgggggagctcctcctgctgtctgagactccacattcaagctgtctcttgcagcagaagagagagcggctcttctcactactgcccccagaaggacagcagctctggtatcaactgtcaactgctagaaatctgacccctttctctgactgcccatcagatgtgttactacagagtcgttttggattgagatgaaggaggggaaatgcctgatctcactcaaatgtgctcattttcctggtctgagtcacagccaggcagcacagtcctgtgggcacaatatcttcacttgccaggttcctataaaatgggagtatctttcttgactgtggaaaatatggagacgaggaaggtcaagcaatagcaaaaggagtacttggagttgcctgagcttccactctggtttccccaaatgttttcaatccatttaattcatgataataaacacctttctgcctaaccagccataatcgcttttcttagatccagatgattcagtgataaaactaaagagaaaaaataaatacacttttcaacgttgaagctgaccaggtgtctgtctctggtgtttacccctccacatcccactatgcatttcatcttccctttgcctcactggagatccaagtgcaagtaatgcttcacatgactgtgatccctagaacttcatcctaatgactgttgacatcttctctgagttttaccagtggaaatggcaataaatagaaagattccagaaggtcccctagggtccatattttctgtacttcctctctaaaatatgtaaagtcaattatgtttgctcttgctttatacgggctagatctatggccccagcacacatctgaacgccctgtgttgacaacttatccagtattgtattgagtctgaatggtcacatgcttatcatatcatttcttccaatttcatgcagtaattgtcatgtcaactgtttggattaagaaccatcagccagaaaaccacagccctgagaaaatagaaatagagtatttcaagctgttcagtgggcatagcaatgatgagtctacagctcattttcaatatataaatattctgttcatgagagtaacagtgtttcagagcctccaccacatctgacagcataacaatgcaatagcacaagagtttgtgtgccagcgttgcttgactaataatgggtttttctttgtctatagggtaagctgcacctgtgcacatgacaagatcatgagctacactttgcttcactttttttgaggtcaataaactgcttgatccaaagccatattatggaagaaattcctgactctgatgaaaacacttggaaaatcctcaaataatattttatgcagaaacataaccgaaaaagaaggcaaattcatatattgcaaataaccagtgccttcctcatgttgcatgaggtccactagaatcacctgacaccagctgttagtctgagccctgatgtgtggtacaatgttaagggttcaagaggcatcagttttcttggcaaattaggtgttcagaagagccaatagccctgtacatctcagttagttgaaactcacattactgagtccccacagggaccttattaacattggttcatgaggctacctggggaagctgggaaaggtgattgactgaagtccatgtgttgaatcatcctgattattaaaagcccctgcttgttaatggcatttcacttaatattcacttggaaagcatttttttttattatggctcatttttgaaatgtctggtcatagcttttgcagaatgactttgtctgaaatcagcctgttgcatttattttaagacttgatgatctgtcaaaaccaacagccaatatttattaaactgctgttatcttgcaatgggatcatcagatgtaaccattgcagtttacccacggttaggatttttacatttccagtgcttctttgacaatgacactaatgtgactccatccagcatgcattgttgtgagaactctatttggcctatcatcattgtgggcatgaacataatggagactttcataggatgcaatggttaatattcaacattagtcaaaatttgctctagtcctacccttggagctctactgggttggaaaaatattttaggtaaggtcaaccatttggtaaagttttaaaaataaaggctacaaagaaattttctgtagcaagagtattgcatacataatagaataaatgtgcttaaatatgaatactatatatatttgtagccaacattttatcaaacaaatatatattcacttctatgtatcttatatatatgcacatttttccataaataaggtaaattttaattttttattgaaatactagttttaattctgttcttaattttctcttaataacttcataaattgatcactaaatattcacatttataccaccaatttaagaaaaaaatacatatgtttatatacacgtagaggtgtaaataccgtatcaggaagcctttatgcataatgattggttactggttaaatacacaactcagtgacagaaaacagtaaacatttgttttcgtgttcgtggatgctcacgttcacaatcctctggctgaccaaggaagggctctgatgagtcgttcctctgcagggcactgagctcaccttcagactacagatatgaattgtctgaggacaaggctgaacagcagtgactacacatgacagaagattcttgtggcaggtcacaggagtgaacaacatcccaaatcaaactgcacagttgaatttaagtccaataatttctaacatagcttcacacattttaaatatattcctttatttcagtgagtacacattttcaagaaaatgtttactccatttaattatagaagggtttgatcattccatgaacaaataattatgttttcaaactttacaatcctgaaaatatttgcaaatgtaaatttgcattaataagaaaataaagctggatgtgttttcaacatgtggcttcaaatataatttatttaaatggactcattggggtaaaaatcattttaacttatgtaaatatccctttttgctgtgcttgtgtcctatagagttgcccaataagagttcctcccatgagatttggaaatcagaaaaggaagactcaatattatccattggtaactaagacaggtacaaggacagaggtgaggactagagaaacacctggaaggatgctgcaggaagctaagagcatcagcacgcctacccctaagcttccagacaggactgaggaccacatggttagaaagcccttactttaggggcggatgcattctgttttctgagggagaaccagagaatcctgcctctaatatcaactttcctgactactgtatccttgtctttgaaaggctgtagtctgaacgttaatcataggcattggttcattcttgttatacccaacagagccaagaaacctagtggggaaaggcactcagggtgcaaaatattgcttctggaatgcaattgaaataggccctgttatcccatggaactaaggtttatggttttttgaataaacttagaaattgtctccccctccctgtcttaaaactcaagatagttacgtctgtcttacctgagtccttttttcagtaaaccaaccatcaggcctcccagatactattaagaagctgaaacttacatatcactgaatcgggacagtgagacaacagaaccttcacccgctgtgattgcataactgacctcctgcttcttcttgaccaaattatcttccttacccctccctaattcctgttttcaacatttcttccctcctatataaacccctaatttattttgtcagagagatacaattgagaatggcgtcccatctcctcggctgcagcacctgattaaagcctgttccttggcaatacttgttgtcttcgagattggctttctgtgtggtgagctgcaggatctacaccaagtccctggtatttcagtaagaaaattctctgcaaccttcagtgctttggcttattgtaacctgaaatcaaatttatccacaatttctgagataacttgatataactctaggattcactttgtccaccactgtttaccagtctgagcttgccagctcccaacccttcctagtgccaatgaactttctcaaagttcaataggtaatatttccctttttcatggaacactgactttttctttgttcttccaacatactgaagaccactgaattttcctgtatgcctcatttggcaaatatttctcttcaaataaaacattaaatttagagattcatctctacattttatttagacttcagtagtttattctaattctctgtattaagactattcctgcttagaatatctatagtggcttcttctgcattatgatttccaactgaagccataaactagactcctcaggtgtcatgatctctgtttttattaaataaggagaagcattgctatgtctgtgaagttggtgctgagaaagagaaaagaattagggtgcagaggtgacttcatgtccccatctaccaacaccatcagagtgtggctgcatctgaggaacactctcagctgatggaggcatcaggagaagcagctggggcagcccagcctcacacatctgcttccctgggggtttatgtttgggtgtgtaacactgtgggagggtaactattatactgttggcagtaataagttgcaaaatcttcaggctgcaggctgctgatggtgagagtgaaatctgtcccagatccactgccgctgaaccttgatgggaccccactttgcaaactggatgcagcatagatcagggacttaggggctttctctggtttctgctgataccaggctaaccagctgctaataccctgactcgcccgacaagtgatggtgactctgtctcctacagatgcagacagtgaggatggagactgggtcatctggatgtcacatctggcacctgagattggaaacataaaaacaaatgtccacacaattaatcatgttgtaagagaatttccctgaatagtaaagcagtactgagcaccctgggctgagtaaactgctagtgttctccatccttacctgggaaacagagcagcaggagccccaggagctgagcgaggaccctcatgtccatgctgtgtcctgactgggtctgattcctgcacaaagtctgaccagcctattaataaggcttcagggcaggaggttgtgctctgggaacatgcaaatgagcaggggatggggcaggctgggcacagctgcagagctggcgcatctgagtaactcagcaccagctcagtgtccccacctgtcccaggtaagatcaaggtagctcaaatttgtctgcagagaatgtgtttctactggggactattttgttatgggaaacattttatggtttctttttgacaatttgaaatattccttgggagtcgatggagcaatgtatttcattggtgtatggggattatttaggagaatattcttttttgtaggaaacacatagtaaaattttagaccctacaattttcaggtcttcaaaagactctcatgtgatttctgttagggaaggtggtacttatcatatacttgcaacatttctgtgagtttaacattgttcctttctaaaaaaaaaattaaaaataaaatttattcacatgatgctacatatatttgtaaatgttaggtaatggtgttatgccattgttcttaccactgtaagatcaagcaatttacttcagatacactaagttgataccgtgtttcctcaatgcatgcagcaattacagatccaccattatcaagagctctaggtctctttaatacccagagactaaatgggctgcaccttattcctgttttgggcaccttcatagtctaccttcttttctgccattaagtattatttcccaacattcatctctcttagtgagggtgatcatcgcatggagcatgtccctgccacgcaccataggtgacactttcttcttttactttttatcagggacatcatcctgacccagacaccaagatccctgttaacatcttttggaaagaggcactcaatcttttatcaagcaactgcccatgtacatggagaaatcagttggttccagatgaaactggacagggatttgcactcgttatatctcatatctctaatgtgcccaaaaatgtcccggcctggttccgtgggaggggaagtggatccaactacatcagcatcagtgggctgcagcctaggactccataaaattttactgatgcctgactaggagagccaaatcacagtgctgtagcctctgcacaaaccttcctgctgctttataagctgcctgaattttaagggaaattgcttatattggaagaaaggaagaaagctccatttgtcctctaaatgtttgctgaaaataaactgacaaaaggaagattaataagagaaaaggcaaacaaaattcacttaaagtgcagcaggatatcatagcaaggtgattacccagataactcaatgggatccaggtgtttatgtttcctttctagggaagaggtaattgggaaatgtaggcaacctggagagaatagatgcgaatagaaatgcatcctcaaaagaacaggtaatcacctccctaggtaaagtatcaactttgagtctcttccatttttgattcctcttttgtgttaatcttccctgacataaaaattctcaggaagagttttcttaaaaattggtttccttctgaagaatttgcttttaggcaggtaggggatgtttaggaaaagccccctgtgcatttcctgctttctaaatgcctttggttttatataatcatcatacaaatgcagcacagtttgagatgttattttctggattcctttacttgcaacccacctgccaagatcctgttccagagagatgtggctacagactgaaagagcagttttcccctcaacaacgtggaggttggggcactgaccactggtgcagatgaaaacctgtgtagaacttttgcatctccaacttatgtagtaatagattacttttgactggaagccttaatgataaaataaatagttgattaacccttttttatgttatacatattatatactctattcttccaataaagtatgctaaagaaaaaatgttattgagaaaaccttaaaaatgagaaaatatatttagtacttattaagcgcttgctcacaggtgacacacagaagaaaatataagtggatctgcaaatttcaaacccaagttattcaagggttaactgtaccatgatgaatgtagcagtccccatctatagtctagggcttttccctttgctgtatctctgctcatttccaatggctatatatatgtcttatgtgcttcatgatcttgggcagagaggtctgcttgcatgccttgctggccagatggcctgcaatgtgtatctcttaggaaagtgctatggtttgactgtgtcctccagaatccatcgttataaagttaaatctcagtgaaatggtattgccaggtggggcctattgagatgtgttagatcatgagggtggagccctctagtggaataccttaatgccactataaacagggtttatggggctggaatctctctgtctcttctgctggtctgtcatgttaagacatggccttcgttcctttgaaggactgaaagctccaggcgtcatcttgaaagcagagaaagaggagcttaacctgcccatgccttgatcttaaatttcccattctccagaaatgtgagaaaataaatttctgttctttatgaattacacagtgtcaaggaacctaacctgttatagcagcttgaaagagaacaagagagacagctcacaatcagtgaggacaggatgaggtgtatacatacctcagcttcctcgtctctcaggtggaatagcccagaggaatttagtccatgtttccacatgtggttgatcttcagttatcctgagtcaggtgggttgttgatgtgtcttttaccattcatcttctgttccctccctcactttcttcctttcctcccagtgtaaatttgctgcctaaacaggaatcctcattgctggtggacccaaactaagatagtaaataaaatcattaatcttttgtatgaggggtatttctcatctgaattcttttatcatttccctttcttcgacatgtaggaatattcaggaaacacacaattttttttaaccaatctattttagattgaatttatgcggtgattttttttgtgtgtgtgttaaaacaaaaaattacgttgtaagccactaaccagctgaacggactcctcttttggtagagagaacttcaaagaaatctgaaaaactaggttaggccacgactggcaggtgggtttagatgtacctcattatatggtccttcctttggagttcagacacaactgaccagcattatcattacaacagagatctttggattgacaaaacagatgctttgtagcaataagataccatactccaacatgacagataataggccctgaagaaaatcaaaatattttaccctaaaagtatttctttgacatattctgaagtgaccctgcaagctgcctgttgtgggggaaatttgcattctgcagagaatctcctccccttactaagtcttttccaaagagtctgacttttttttaaggtctgataaacaacattagccacctactttgtttgctacccacaggattcatctaggtgacaagaacctttgcttccacaccctcttttctaaactcaagcatttctttatgatgaattcaagtgtttaggcagagcttaactctttcaaccagttggcagtcaggaaatctttgaatccacctatgacctggaagcccctacttcaagctatcctacctttccaggacaaactaatgtaaatcttatatgtattgatttatgtctttccctgtaatttctgtctctccaaagtatttcaatgtgtattcttgtcaccctgggcacatgtttgcaggacatcctaaggctgtgtcacaggccataagctttgggaaaataaacctgtaaattgattgagacccgtctcagatactgttttgtttatactggtcacaaacttaaaaatcctctaaaacaatctacacatcaataaatctacattagagacagtggaatgatcataccttaacagttaaagctcacaatttaaaggaacctgagtctaagattttggccagctctcttgcttcataaaaaatacttcgtgatttttaaaattttactttagagaaaggcaatttgggggaatatatttattgtcaatgggatgaataatgtctctaccctaaaagatgtccatgtcctcatctctggaacccaagtgttacaggagttattaagaaattattttaggcggataggaaaagagtgtccttggtaaggttttctttcatttaaagcagctccagaaacgtttcttgtctagcaggaaagccctggctcttagagccaggctgggaagctttgatttgcaaattccggccattagaaactgagtccagccaaacctgtcaattcccaccatcttcttccttgcccccacatgtgcctgacaacaaggctgcccccacatatccccatgtgtatagaatattttggcgccctgtatttgcatattaaaagtcttgttgggaaggccagttattttgcaggcttcatgaatggcatgcctggtcaaaccagtccctagagccctatataaatcagacaccacctcctccagcctcctcatataagagccacttttctgctgcaatggagttttgtctttgttggaatccctcctccctctgtctctgtgtgggggagctgttttcttcctccgtccttcttgcatattaaacctttctctccctaaaaccactccacgtgtgtctgtgttgttttatccaaagtggtgtgagaccaagaaccctggtgttcctccagtcaacggagccgtatcataaaaattctaccttacatagcaaaaaaagaacttgacagatataagtgaagaataagcgacccagttatctagatgaaaccaatatgatcacaaaggtccttaaaataaaagaggaggcttgcagtcagagaggagctgggacaatggagagggatgtggtttgaagagggaacgggttactctgctacaaaaaaaaaatatgaccacgggggtactttgcttaaaaaatatcccagaatgtcctgctatacttagagagcatttgcttcccaaatagaaaatgaaggcctccttcatttcacaccagtttctgctacatgcactgtattgctctgttgcttggtgtctacgcacttagaactgctctgtcttctttccgaaatgactttcttcattatgtaatgtacatttctgtcactggtaacattcttggctttgtagtctactttatctgatattagtatttgctactgattcattttattaattttgcatactatgccattttcttttcttttatattgagtctacttctagtgtcatatttgatgtgagtgtcttatagacagtatactgttcggacatttctttttgattcatcaattgctgtctgttataatttactaatttgcatatttaatatatcgataattattgatatactaagatttaagtcttcgctctacttttttgctgtatctttttttgcttctccgttttctttttgctgccttcctttgggttacttgaacatttttagaatttcattttaattttacctaatttgagggtatctctttttatagtgatttttaaattggttgtcatggtatttcctttatatccatagcttctcacagtatgttggtgtcataatattaccatttaaaataaatataaaattttaccttgttttatgtcatttttcttcccccattagtaatagattgtgcacatatactcatgtacgcttcacaccatctctagcctacttataatacctgacgcaatatgtatacatgacttaacctgtgtggattcaaccaagtggtactaagcacatggtgaagtcaagttttgctttttggaaatttgtggattttttttctatatatttttgatccaggtttagttgaatccatggatgcagatcccatggatagagagatgactatactgctccttataactctgaggatcaactctgtggttcctccattctgggctggctgaactgatctctgctgagcctgctcatgtgtctgcagttaccctgtggttcagttgtgactagatggtctgatatgacttgtttaacctatctggaagctgatttgatgtgcaggttggacaacatttggtttcggtttacataggtcagggagatggggcctgttccccaacctctattcagttcgtttctagatcaactcaggagttcgtctattcattgtaggttgtttgggggaaattccacacaaaacgttggtaatgaagaagctgaactgctgtcatcagttattgttatcatctgaaatgcatcatatattaccaaagtctctccagggtggcccaacagtgcagctcagctcaccccatccagtcacttccctggttgcctgcaggtgtgagaaaggcaatgtgctcagtcacaggaaagacaggggccctccctggtgctgaaacctgcagatagttttcacacagtttcattccaaaatacaaagacttcattttctttgtctttaaaatagttatacattttctttctataatgtccccatgcttttcaactaatttgaattttcagaactggaagtatttattatttctgtgttagatgctcttagtcacttatggcaagagtgagttaatagagacaggatatggattagccatagaacaatacagaagtgtgtggattcagataggataaagatcaaagcggtgacaaatacattcttttgaagcggattctcataggtcaccagtcaatgtccgcattcaaggtgcgatgatgtgtcagctacattgtgcaaatggtcagctctgcagagtaaacttggacagcacactacaggaccaaaattacctgtaaaggtatggggaaaataaaccatcatagaaataatagtgtgaaggagtttttggttatttatacttggatatcaagcagaacactataatcaacgaagctataaccgaaaaactttaagacttttaaagaggtttcccttttctcagggtatttctcaggaaaaaatttataaattatggataaactacttgcacaattagctgcaataaatcccttccctgcactcatcctttggttggcctcattctaaatggactcaggtgttacctatgtgtcttgctcaggccaataggataatagcagatgtgacagaattggaatattggaaagggcttgcacatcgaagctttcctctctttcacagtgcttggaaaccctaaggtcacaatgagaataagcctgtgcccatctccattcaatgtcagtggcatggctgctcttaggtctattatttgttcttaaaatgtgtgttcagtttgttataaacatgtaagaaattacctgcaaatttatcaacttaagactacacccatttataatctctcaatttctgagtcagcagtcagcacatggctttgctggatcctgcccattggatttcacaagactgtgccacagtgtagactgttcttcattctcacctgagactccctgagaagagagatattttagagctctttcaggtagttgcagagcccatgccttagcacctctgtgactcagggcttcagcttcttactggctcttggctcaaggctgctctcaggtcccagaggctgtggacaattccctgccatgtgatgctcacacaggcaatgcccacatggctggttgtttgttcaaggccagcagaaggtttcagagagtgtctctttccagtctgctatgacagaggcttacagaatacaatacaatcattggaaagacatctcataacctctgccataccatatgggttagaagcaagcctaagttctgcctgttctctgtggaggtagatcacacaatgccatgactcactggagagaggtttctgctagggtgttctggcatctttagtttcctcaaatatcagggtactcatactgagtgtgaaatctctcctacatctacttcatcgtgctgtgtctgactgatcagacatttgacacatgacttttttttttttttttgtgacggagtctcactctgtcgccgaggctggagtgcaatggcatcatgtcggcccactgcaacctctgtctcctgggttcaagcaattctcctgcctcagcctcccgagcagctgggattacaggcacccaccaccatgccaggctagtttttatattttcagtagagacggggtttcaccatgttggccaggctggtctcaaactcctgacctcaggtgatccacccatctcggcgccccaagatgggattatagggatgagctaccatgcctagcctactttagtttttaagtagatttaatgaaatctatttagtagccaaaagccaagaatgccaatagttttacctggctactctctgaaacaatggtattaaaaggggtctttccagcccctttccagcagaaagacaggtactaagaaacagtggaagtgtgaaggtgggggaagggagagaaacagtttttatatacctaaactaacccagctgcatgtaaaccagtaactactcatcaaaataaaatacagaaagcatattagttttggtttggtgtgaaccagccttaaatacaaagttgttacactgaatgggtttaattgaccaaaatgcatagggaaggcagaaaggattaggatgcccttctactcagctttatctgctgtcgagtctggttcctcaggggacacatggatcccctccattgtcctgcagattctgccaggccaaggctgttaaatctggcggggtctcatgtgtggacttctgggtgtatacagggagaaactagagaaaggccgagcagatttttactgcatgtaggtaatctacgtgggcttttagagaaaaaaggctttagataaaaagtgtttgacaaagtcacacatggtttgtaaaaaaacaaaaaataaaatacaacttgaaaactcttggagaagtgacactttagtttcccaaatcactcttcttcatacacttccacttagctttttttcaccttctagctctgtggtcttagaaggacatgcacttaaaataatttgtttccataggaatccaacaagtaaaagcataaacaacatcaaataaactacatcattaacatagaagcatgtcaaagaaactgagattagattttgagttttggcacaagtattagagaaatagagaaaagatttaaaagatagaataagacttacacaagaaagcaggacagcaatacgacaattgaacctatcatagaataataggttgtgataatggatggtgagaagaaatgcattggacagacatgcatgggcatgattgatttgagcaatttagcatggatcaagacaaaatctttaggatttaaagggctgtgagctgggtagtaaaaacccccattttagcacctcttggggctgtagatggaaagaacttggatttaaaactattttcaataagtgtctgctaagtgctaagtattatagctataaggatacctaaattaatagaagcacatattatctgttggataatattctaaatcttttaccttgtttaaattgtaaaccgacctatgaggtagaacctattattgtcacagcattgcgggtatagaaaaggaggcaaaggggggttaagttactttactaatgtcacacaacatgtaagcggtaaagctccatccccaaccccaagggtttgacttcagggcctgccaagacaacatctggactgttgcatggatcttgcctggctgtacatgaagctctaattccaggatggatgaagattccattagaacttggagtagcattaataaaattgcttccttgagaccaggcgaagtgtccagaaagcaaaggagtttaactgcttaaaggaaaggtgcagatttgtaggaaatgaagctctggactgtgaacagagtttttcaaaacaattaaggagaagagaaattgagtctagtttgatagatgtgttgtgcagagtgagtgtagtggagattagagaatcagccaaggaattatcccctgccttcatggatggcatcaacatctgtcttcatggcaattgtattggcagcctgagtgtcagagcctgggtcctgcccatccatgcagctgtggtcacctttgcacctgcagtgctggagttacttgagtgttactctttgaggtagcttcaggacacttggtaaaaatcactaagtggcaagtgaaagacttggaagaaaagttctaatcagctcttctttcccacctgatgcaatttttgctgctgctgggaccccaagttctttgtctcctccccgctgcttttttttttttttgagacagagttttgcttttgtttcccaggctgaagtacagtggtgtgatctcagctcactgcaacctctgcctcctgggttcaagtgattctcctgcctcagcctcccaagtagctgggattacaagtgtgcacccccacgcctggctaattttgtatttttagtagagatggggtttcaccatgttggtcaggctggtttcaaactcctgacttccggtgatccacccacctcggcctcccagagtactgagattataggtgtgagccatcgtgcctgaccccttgcctcttttgtaaatagaaatcaacaccaggccaaacagaaattgtctcaggcaaggtttagtaggtttgtggcaagagcaaagcaagggagcagcctatgggtaagagatcctggtggctattccttgaagtgcccagctcttaccattttaaggaagctgaggcggaaaaaggaatgacatacaagcatggttaggcaaagttttctttgcatttgtgcagtggagcgtcatgctctaacatatataacatgatgaggaaatggaagataagccctgccttgggtggatattttagtattacaatgagattataatgaggaaaaatcagtgaaaggtcagttctggggaccatcccactttcagctggctagatctcatttggtgctttggggaaatgccagctctatcagcaaccttggaagatggtcaggttcttatcaggaatgttagagttccactttagaaaccttgggaggctgggcacagtggctcacgcctataatcccagcactttgggaggctgaggaaggcagatcactggaggtcagcagtttgagaccagcctggccaacatggtgaaacgctgtctctactaaaagtacaaaacatagccgggcatggtggtgtgcacctgtagtcctagctactctggaggttgaggcaggagaatcgcttgaacctggaaggcataggttgcagtgagtgtagatcgtgccactgcactgcatcctgagtgacagagtgagactatctgaggaaaaaaaaaaatgaaatcttgagatactcaggccctatcattttcctacagcaagtgaggagttgccattcaaaagaggcacaactggtggccacttcaggaaacttttgcatccaaaagctgagtctggtgcacctagtgacattgccacagactccagtcagcatgcatagaaatagtggatacctggatttccatcgagcaagcaggctctaaaggtcttaaataaatgccttggacatgtatagttgaatagattccaaggctaccgttgcaaagggctccattcaaagttggcaactttgttcatgattttgactaaggtgaccaaaaaaaaaaaaaaaaaagactcagggggacagtgcaactaggtgagaacccagtggctttcccgagcttatttgtcttgcatttttggtgacatggattgttgttcacattgtcttcctctggcaggtccacctggaaagcattatatatttagcaagaaaaaaggaggctgtgaatgatgtcactgcggactgcgtatattccctgttgcaaatgtcagatccatgaagcataaagtgattaactagaagatattaaattccttacaaattgttgaaaagccttaaagaacaggctccagtcaaagcctctagaacaattccaagaatcatactgctggcacaggctggggaggagctcctactgtttgagacattcaagctgtcttttgcagcagaaaagagaccagctcttctcactactgcccccaggaggacagcagctctgctatcaactgtcaactgctggaaatctgacccctttctctgactgcccatcagatgtgttactacagagtcgttttggattgagatgagggaggggaaatgtctgatctcactcaaatgtgctcattttcctggtctcggtctcagccaggcagcacagtcctgtgggcacaatatcttcacttgccaggttcctataaaatgagagtatctttcttgactgtggaaaatatggagatgaggagggtcaagcaatagcaaaaggagtacttggagttgcctgagcttccactctggtttccccaaatgttttcaatccatttaattcatgataataaacacctttctgcctaaccagccataatcgcttttcttagatccaaatgattcagtgataaaactaaagagaaaaaataaatacacttttcaacgttgaagctgactaggtgtctgtctctggtgtttacccctccacattccactatgcatttcatcttccctttgcctcactggagatccaagtgcaagtaatgcttcacataactgtgatccctagaacttcatcctgatgactgttgacatcttctctgagttttaccagtggaaatggcaataaatagaaagattccagaaggtcccctagggtccatattttctgtacttcctctctaaaatatgtaaagtcaattatgtttgctcttgctttatacgggctagatctatggccccagcacacatctgaacgccctgtgttgacaacttatccagtattgtattgagtctgaatggtcacatgcttatcatatcatttcttccaatttcatgcaataattgtcatgtcaactgtttggattaagaaccatcagccagaaaaccacagccctgagaaaatagaaatagagtatttcaagctgttcagttggcataagaatgatgaatctgcagctcattttcaagatataaatattctgtttatggaagtaacagcaccattcatgattagtgtttcagagcctccaccacttctgacagcatagcaattcaatagcacaaaggtttgtgtgacagctttgcttgactaataatgggtttttccctgtctatagggaaagctgcacctgtgcacatgacaagagcatgagctacattttgcttcactttttttgaggcaaataagttgcttgatccaaagccatattatggaagaacttcctgactctgatgaaaactctttgaaaatccacaaataatattttatgcagaaacataaccgaaaaggaaggcaaatccatatatagtaaaataaccactgccatcctcatgttccatgaggtccactagaatcacctgataccagtaattagtctgagccctgatgtgtggtacaatgttaagggttctggaggggtcagttttcttggcaaattgggtgttcagaagagccagtagccctgtacatctcagttagttgaaagtcatattattgagtctccacagggacctccataacactggttcgtgaggctagctgggaaagctggaagaggtaactgaagtccatatgttgaatcatcctcattattaaaagcccgctgctcgttaatggcatttcaattaatattcacttggaaagcttcttattcttgattatggctcatttttgaaacttctagtcatagctcttacagaatgactttgtctgaaatcatcctgttgcatttcttttaaggcctgatgatctgtcaaaaccaacagccaatattattaaactgctgttctctttgcaacgtgatcatcagatgtaggccttgcagtttacccactgttatgagttttacatttccagagcttccttgacaatggcactgatgtgactccatccagcatccattgttgtgagaactctatttggaatatcatcattgtgggcatgaacataatggagacttttataggatgcaatggttaatattcaacattagtcaaaatttgctctagccttacccttggagctctactggattggaaaaatattttaggtaaggacaaccatttggtaaagttttaaaaataaaggctacaaataaattttctgtagcaagagtatgaattaggtgtcatcacaaataccatttttttgtgtggaatgtaacaattatttaaacgtatataatttagataatattttataaataaaatatgtatatattgcatatataacagaataaatgtacttaaatatgaatactgtacgtagttgtagccaacattttatcaaataaatatatgttcacttctatgtatcttaaatatatatgcacttttttccataaagaaggtaaattttaattttttattgaaatactaattagttttaattttgtgtttttctcttaataacttcataatttgattactaaatattcatatttataccaccaattcaagaaaaaatatgtatgtttatataggtagaggtgtaaatactgtatcaggaagtgtttatgcattaattacggtaactggttaaatgtacaactcagtggctgataacagtaaacatttgttttcacgttcatagatgctcatgttcacaatcatctggctgatcaaggaaggtctctgctgagtggctcctctcagcagagaggagcctgtagattgtattcagcctgtagatatcagttgtttaacgacaaggctgaacagcagtgactacacatgacacaagattcttgtggcaggtcacagtagtgatcaacatcccaaaccaaaccgcacagttgaatttaagtccaataatttctaacatagcttcaaacattttaaatatattcctttatttcaatgagtataagtttttaagaaaatgtttactccacttaattgtagaggtgtttgatcattccatagacaaataatcatgttttcaaccttcacaatcctgaaaatatttgcaaatgtaagtttgcattaataagaaagcaaagctggatgtgttttcaacatgtggcttcaaatataatttttttaaatgacctttttgggggaaaatcattttaacttatggaaatatccctctttacctctcatgtcctatagggttgcccaataagagggtcccccatgagatttggaagtgagaaaaggaagactcagtattatccattggtacctaagaggcagagagacaaaggtgaggactggagaaacacctggaaagatgctctaggaagcgagaacttcagcaattccagacttaagcttccagacaggactgaggaccacatggttagaaaacccttacttcaggggtggatacattctgttttcagtgggagcaccaaagaatgctgcttctaatatcaactttcctgaatactatatccttggttttgaaaggttgtagtgtgaatgttaatcataggaattgggtcattcttgtcataccaaacagagccatgaaaccagaggggaaaggcactcagggtgaaaaatattgtttctagaatgcaattgaaataggccctattatgccatggaactaatgtttatggttttttgaataaacatagaaattgacttccctgatcttaaaactcaagatagttacatctgtcttacctgagttcttttttcagtaaaccaaccatcaggcctcccagatactatcaaggagctgaaacttacatatcactgaatcaggacagtgggacatcagacccttcactcattatgactgcataactgacctcctgcttcttgttgaccaaattatctcccttaaccctccataattcctgttttcccacatttcttccatgctatataaacccctaatttttgttggtcagggatacatttgagaatggtgtcccatctcctcagctacagcacctgattaaagccttttccttggcaatacttgccttagtgattggctttctgagtggtgagctgcaggatctacgctgaatccctggtatttcagtaacaaaacactctgcaaccttcactgctttggcttcttgtaacctgaaatcaaatttgtccacaacttctgagataacttgatataattctaggattcactttgtccaccactgcttcccagtctgagcttgccagctcccaacccttcctagtgccaatgaactttctcaaagagccataggtaatattttccctttttcatgaaacactaactttttctttgttcttgccacatattgaagaccactgagttttcctgtatgccccatttgggaaatatttctgtgtaaataaaacattacatttagagattcatctctacattttatttagacgtcagtagtttactttaattctctgtattaagacaattcctgcctagaatatctatagtggcttcttctctgttatataaagtccaactgaagccataaactagactcctcaggtgtcatgatctctgtctgtattaaattcggagaggcattgctatgtctgtgtagttggggctgagaaagagaaaagaattagggtgcagaggtgacttcatgtccccttctaccaacaccatcagagtgtggctgcatctgaggaacaatctcagccgatggaggcatcaggaggagcagctggggcagcccagcctcacacatcttcttccctgggggtttatgttcgggtgtgtaacactgtgggagggtaactattatgctgtagacagtaataagttgcaaaatcttcaggctgcaggctgctgattgtgagagtgaattctgtcccagatccactgccgctgaaccttgatgggaccccactttgcaaactggatgcagcatagatcaggtgcttagggactttccctggtttctgctgaaaccaggctaaataattgctaatgccctgcctcgcccgacaagtgatggtgactctgtctcctacagatgcagacatggcagatggagactgggtcatctggatgttacatctggcacctgagattggaaacataaaaacaaatgtccacacaattaatcatgttgtaagagaatttccctgaacagtaaagcagtactgagcactctgggctgagtaaactgttagtgttctccatccttacctgggaaccagagcagcaggagccccaggagctgagcagggaccctcatgtccatgctgtgtcctgagtgggactgattcctccatgaagtgtgtccagcctattaataaggcttcagggcaggaggctatgctctgggaacatgcaaatgagcaggggatggggcaggctgggcgcagctgcagggctggctcatctcagtaactcagcagcagctcagtgtccccaggtgtcccaggtaagatcagggtagcacagatttgtctgcagagaatgggtttctactggagactattttgttacgagagacattttttagattttttttgacaatttgaaatattccttaggagtccgtggagtatcatatttcattggcgtatggggagtatataggaggatattctttttttgtaggaaacacatagtaaagttttagacgatagaattctaaggtctttaaaagactattgtataattccggttagggaagggggtatttattgtatacttgcaacttttctgtaagtttatcattgttcctttctaaaaaaaattaaaaataaaatatattgacatgatgatgcatatatttgtaagtatgaggtaatggtgttatactattgttcttaccagtataagttcaagcaatttactacaaatacacaaagatgataccatgtttcctcaatgcatgcagcactcacacattcaccattatcaagagtgacaggtctcttcaatacccagagactaaatgggctgtaccttattcttgttttgggcaacttatagtctaccttcttttctgccattgagtactattttccaaagtttatctctcttagtgagcatggccactgcacggagcatgtctctgccatgcaccatcaatgccactgtccgcttttacattttatcagtgagtgggaacatcatcctgacccagacaccagcctccctgctaacatctttaggaaagagacactcaatcttttatcaagcaactgcccatgttcatggacaaatcagttggatccagatgaaattggacatggatttgcactcgttatatctcacatctctaatgtgcccaaaaatgtcccagcctggttcagtagcagggaaagtggatacaaccatatcagcatcagtgggctgcagcctagggctccacaaaattttactgatgcctgactaggggagccaaatcacagtgctgtagcttgtgcacaaatcttcctgctgctttataggctgcctgaattttaagggaacttgcttatattgggagaaaggaagaatgttccatttgccctctaaatgtttgctaaaaataaactgacaaaaggaagattaataagagaaaaggcaaactcaattcacttaaagtgcagcaggatatcatagcagggtgattacccagataagtcagtgaaatccaggtgtttatatttcttgtttagggaagagggaattgggaagtgtaggcaacctggagagaatagatgagaatagaagtgcatcctcaaaagaataggtaatcacctgcctggatgaaatatgaacttccagtcttttctatttttgactcctgttttgtgtcaatcttccctgatataaatattctcaggaagaattttcttaaaaattggtttccttctgaagaatttgcttttaggaagataagggatatttaggaaaagcctttttgtgcatttgtcgctttctaaatgcctttagttttacataatcatcatacaaatgcagcacagtttgagatgttattttctggattcctttacttggaacccacctgccaaaatcctgttccagagagatgcagctacagactgaaagagcagttgacccctgaacaatgtggaggttggggcactgaccactagtgcagttgaaaacctgtgtagaacttttgcatccctaacttaagtactaatagattacttttgactagaagccttagtgatcacataaatagttgattaacccttttttatattatacatattatatactctattcttccaataaagtatgctaaagaaaaaaatgtttttaagaaaaccataaaaatgagaaaacatatttactacttacaaagtgcttgctcacaggtgacacacacagaagaaaatataagtggatctgcaaatttcaaacccaagttattcaaggattaactgtaccatgatgaatgtagcagtccccatctgtgatctggggctttcccctttgctgtacctctgctcacttccaatggccatatattgtcttatgttctttatgatcttgggcagagagatctgtctgtatgccttgctggccagatggcctggaatgtgtatctcttaggaaagttttatggtttgactgtgtcctccagaatccatctgttgtaaagttaaatctcagtgtaatggtattgccaggtggggcctattgggatgtgtttaggtcatgaggtgaagccctctagtggaatacattaatgccactataaagaggaattacaggactggaatccttttctctcttccatccgtctgtcatgttaagacaaggcctttcttcctttgaaggagtcaatgctccaggcatcatcttgaaagcagagaaagcagaccttaacctgcccatgccttgatcttaaatttcccattccccagaagtgtgagaaaattaatttctgttctttataaattacacagtgacaaggaacctgttataacagtttgaaatggaacaagagagacagctcacaatcagtgaggacaggatgaggtgtatacataccccagcttcctcatttctcagatggaacagcccagaggaatttagtccatgtttccacatgtggttgatctttagttatcctgagtcaggtgggctgttgatgtgtcttttaccattcattttctgctcccaccctcactttcttcctttcttcgcactgtaaatttgctgcctaaacaggaatcctcattgctggtggacccaaaccaagatagtgaaaaaaattgtttatcttttgtatgaggggtatttcccatgtttattcttgtcacttctctttctttgacatgtaggaatatccaggaagcacttaattttttttaaccaatctattttagattgaatttaggcggtgattttttttgttctgtttgttaaaacaaaaaaataagttgtaagccaccaatcagctgaacggtctcttcttgtggcagagagaacttcaaagaaaacagaaaaactaggttaggccatgactggcaggtgggtttcgatgtgcctcattatactctcctcactttggagttcagacaaaactgaccaacattatcattacgagagacagctttggactgacaaaacagatgctttgtagcgataagataccatactccaacatgacagataataggccctgaagaaaatctaaatattttaccttaaaagtaattcttcatcatattctgaagtggccctgcaaagctgcctgtagtggaggaaatttgcattctgcagagaaactcctccccttactcagtcttttccaaagagtctgacattttttttaaggtctgataggcaacattcaccatctactttgtctgctacccataggactcttctacatgacaagaaccttggcttccacacccccttatctaaactcaagtatttatttatgatgaattcaactctttaggcagagcttaactctttcaaccagtggccagtcaggaaacctttgaatccatgtatgacctggaagcctctgcttcaaaatatcccacctttccaggacaaactaatgtatatcttatatgtattgatttatgtctttcctcataatttctgtctctccaaagtgtttaaaaccaatgtgtaatccaaccaccttgggcacatatttgcaggacatcctaaggctgtgtcacaggccataagccttatctttggcaaaataaacctataacttgattgagacccgtctcagatactgttttgtttacactggatcacaaacttaaaaatcctctaaaacaatctacacagcaataaatctacattagagtcagtggagtgatcataccttaacagttaaagctcacaatttaaaggaacctgagtctaagattttgtccagctctgtttcataaaaatactttgcgatttttaaaattttactttagagaaggacaattttggggaatatgtttattgttggtggaatgaataatgtccccaccccgaaagatgcccatgtcctcgtctctggaacccaattgatataggagttattaagaaattattttaggcagatagagaggaaaaggtgtccttgggaaggttttgtttcttttaaagtagctccagaaaagtttcttgcctagcaggaaagccctgattcttagagccaggctggcaagctttgatatgcaaattctggccattagaaactgagtccagccaaacatggcgactcccaccatcttcctcctggctcccacatatgcctggccacatggctgcccccatatatccccatgtgtatagaatattttggcaccctgcatttgtatattaaaaggctatggtgggaaggccagttatattgtaggctacatgaatgacatgcctggtcaaaccaatcctgagagccctatgcaaatcagacaccacttcctccagcctcctcatataggagtctcttttctgctgcacagagagttttctctttgaatcacaccttcccctgtctctgtatgggggaggtgttttcttcttccttccttcttgcatattaaacctttctctccttaaaacactccacatgtgtctgtgtcgttttatccaaactggcgtgagatcaagaactctggtgttcctccagtcactggagccatatcataaaaattctaccttacatagcaaaaagagaacttgacagatgtaagttaaggactttgagaataagaaacctggttatcgaaatgaaaccaatataatcacaaagtccttaaaatagaggaggaggctcacagtcagagaggagctgagacaatagggagggatgtggtttgaggaaggaaggggccatggaaccagaactatgggagcacctggaacgtaaaaagcagagaatccagttctctcctctggatcctccagaaggaatgcagccctactgacaccttagcattagctcagtgagacttctgacctccagaattacagggtaatacatttatgttgtgtgaagccaataagactgtggtgatttaaacagcagcgttggaaactaatgcaaggggaagagatgtctttcagctcactgagtgcatgactgtcctctgttcttggaaatatttccaccttgttttctggtgtcagttttgacaagagacagagaaaatgtttctgagagaagagctaggacaagaattctttttagctagaaaatctcttgggtaaaatcccatgactatctcttatacgatctgggtatcacagagtttagcggtcagatctcacagcacatgataggaggaagagacttctgttagtttgttttcatgttaggagggaaaattgattttcagcacacaatctgagaaagacaaactgagtcagagatattgtaagagaaagaggagatgtggaaggattcagggcaatgaaacatgtgtcccagctccaaaatctaaaataaagtcattgattatcaaaggtgaagcaaagctcttcaccttccatcttcttatgaaggatcaaattcttcccagagtccctgcccctccttcactcccctgacattgcattgtggagctaatcacatgtatccttaatccctgctcctgtcccgggctgggagaggctcactgtcctcaccatgtccagcaggatagagctggtgtcctaggcaccaaaggagaagaagatggtttctgtgcaggcaataagagctttgccacacattacatttcgctataactctaagtaaagttgtgtggagagaagagaacatatgggcaactttacctggtgggcttggaagaggccaggctctgagaatgacaatgaattcacatttctacttttccagatggcaaatgccagctttagcaattatggaaatgtggactttgagtttaagaacaagacagactttccagtactacaataaatgaggagacatttggaatagggtccttaacccagggctacagtcaggctggcagtgcctgagagctgcccgatgctgaccctaagctgtggaggaagcagctgctctcctgagccacagagctgaggacctgggaggaaccacaggccctggccacagggctgcctggcaggggcttaagggaaggaaactgctcacaaattcacgagagctgcattaagcatatatcctgcagcctggcaagagtaaaagtctcaagacccagacctcgggactagctctgggttcctgggatgggtgctgtcagctgtgccctccctggtactgaatgactgggaccttgttggagccaaagagggagagtctgcaaatgtactcaaagtctttactcagccagactctgttctgcttggaaataaaaggaacacacgctacaaaaataaatgtaaaattatgtgtatatgtaatatgaatttctaatataaactttacatattgaatacatataatactttagaagtaagttgtatttatatatttgtatatactatgtatctgtttatgaaaaaatatgcgatgcacgtttatatataaagagaactttgattgctagtataaggtatagttttaaactttaataagttgaacatgaacattgaaaatgagcactgggtgtaccaccacatggcccctttctcactacaggacctgagggtcataaagctcaggaccctcttccacgttcccctgggctgagagcagagagctgcccattgctgaggataataagtgacctgaggtgggtgtgcagaatcacagagcagcagatgcccaggagatggatagtggctctgggccctgaatggagggaagttttgtcaccagagctcagcatagacaagtcctcttctggtcatttccatcaaacaaagcagcacatgtggctcagaggctgcatagtcacaggatgaagacccgccatggctcattcccagcttcccctctgactggggtgatgtgggatctcactgcccaggtttcatgactcaccagctgctgggactctgttgacaatggcctatgtctgctccatgcacaagcttctcagtatttgacattttactttctggtctccagtaaccacgacttgccaaccatgacccttccacaaagattcatggagtggggtcagaactatgggttcagcaatgtgctgggccatgtatataagagaaacaaggcgcggccagcccatgtctgaagtgaggatgaatttgcatcatgaattcagagaaggaggtgggagaaaacatcctgacatgctccgtgcagtgatgcccacaagatacactggaggtgaccatagaggaggtgggaagggagtttgagacaaagtgaattcagaggtgtccctcagcctgttgccctgagaagacttcagacccttagcagcccctgggcagagctgttgctagggaagatttgtgcatgataggaaacaggaggagggagcacctacctctgaaggcatcttggttggtgatggccagagtgaaatatgttcaggcccaccgcccctgacccaggcagggatcatgtccagtggggcagcaggatcaagcaggagcaggagctcagagccagatctggtttccgctggtgccagactaggatgtttttcatactccagcaggccctgcaggtgacagtgaccctctcacttgggacacagggagggggctggagatggcatccgcacaacatgctgactattatccaagtgcggaacaaacatgcaaatctcccaatattaatacgaagcaagtagtttgttcaatttgatgcaattctgatcagaaaaaaagtgggctaacaacttcatcatcaaagaaatgttcatgtttgatacaaactatctgaggatgaagcctcagttccccttcctcaccaggcagtcagaacagaaggaggaagagaagaaaagctgggtcccaaagtccacaaggtgcctcctgaggctgattctgctcagagaaggtggggacggtagattgtctgctgggactgccacatcaaaattccctgggcaggatggcttaaaggaaagaaatttacttctaacagtttggaaggctggaaagtccaagatcaaggtccagaaaggtctgctttctgctgaggaccctccctctgattttcagatgccaccttctgtccatgtcctcacatggcctttcctcactgcatgcatggagggagggggtggaggagagctcagtggggtctctttttataaagacactagtcttattgaatcagggccccatccttattatctcctttaactctaattaccaccttatatgctttatcttcaaatgtagctatattagaggttagagattcaagagaagagtttctgaagcacaattcagtccatagcagatgggctttggggacacagccaaggcagcagtgaaggcaaggctgggcttctagtctcagagcacagagcacagaggtggttcccacagtgcaggatgctggcagctcctcccaggtactctaggtaccacagagaccacattccagccttaggggctacctgttgataataggacactatcactcttaacctctccaagtatttctctgatcagggttatatcttagggttattatggggtttgtctaccacctagtcttaagattgtagcttagcctcttatataggattgtagatgctgagtcccggtgagtcttgaccgtgagtcttttcacgggtattaatgaaggggatctcaggccagattcatccatcactaggccagattcacaaaacaatttctcttctcaacaaactagctgcatagttgaggccaaaagatagtcagaaaagttatttgtcaaaaaaatattgtgggctagattctgtgacccatgtgagatgccaaagttttggaaaagagatgatgggccacgaggaatcctgcaggacataatggcaggggtggggatgggaagcacagggccctgttctggaactgtcatcccagtctcattcctcccatccaagaaagccttccagagaagctctgaggaccacagcagcagctccagtcaagaaggatccaggccacactgccctctgaatgaaagctgctgaggcctgtgctctaagcagtaacactgagtgaccacatgtcatcattgaggtcagcaccagccaaaacaatttttctaagatgatgaaaatgtctgtatttatgctctgcaagggtagccattaatcatatgtggttactgagcccttgaaatacagcatgtataactaagaatctacatttttaactttaattaagtctgatttacatatttgcagctatgcattgctagtgttaaccacgtgagacagcacagttttagacaataataaccaacaatgtcatcaggacaactaagttgctaattaacaagcgagggtcttttccaggaccattgcaccaagctggggctgtatgttggtcaaagtagaccacgtgggtggatctttggaatcttttctggattctactgcttctaggcaggtggtagaaactcttcctcttggagacactgagggagagactggagactggggtctacagtgttgccactagaatctgaggtggaaacaaaacacaaatcttccccagtattaatgatgtctcactctgtgggcttcccagcagagtcctgctggctgaccaagcagtaggtgaatgcaggaggtgaatgctgggctccctgagcaatggactcaatctcagtcccatgggacatttgagccctgtcacatggagcccccacagctgaggtcagggcaccaggacactaagggccagagtgctatgtccagtgtccagtgctccccctgcctcagatggtcccaccccaaaggcagcgaccaacacaccaataagggcttgagtggcagggaggggctttaggaagcctgcaaactagcaacaaaggagagatctgggcttccagcttctgagcaagagaacattctgtgtcatgggtatgatccaggccaaggtatttggtgaaagatattaggataaattttattcttaagggaataaaatcacagaaggcattggattattataggattgattggctattacaaaggtttaaaaacatacttttttcaatacacagttgtttatctgaaatcccccggtccctgccctcctaatggtgatccgttcaccacggtcacttcattgtcttctcatcactcagatacatcttcagtatgaccctgagaccttccccgatcagcacaaataaatggcctcagactccagataccacatatcattacctgacttttatgtagtttgtcaactactgaaagtattctattcagtttcattatgtggttattgttctgtgcatggctcattcccctactgaatatcagtgcttgggatcaaaatttgtcttaattattcacatgcatcttaccctcaaatgatggcatttacttgttcctgaaaaatatgatattaagtgaaaattcattaaattcaaaaatatgtctgtctttcttattggaaaaatatgtgatacattcccctcaactagagagacttagctacttttacagttggaaaagattgattggacacaaatctataaaaacacatttataggagtaacaagcatcattttgaaaatctgctttgcttgtaaaatgtccagtatgatgaactgtacacaacacagaaggaagaaaggtcctcacggaggatggggcctgatagagagggtgggggagtcagttctttgaagcatggggagggtctaataagtgacctcaggcaggtgtccaataccaggaccagatatttctaattacaactttattttccttaaggtttctgcatatacatagaataagtggaatacaggttgaatgcaacatgcttcagaacacatacaaacagcccacacacataaaaactaaagaatcttacagaatgttgtctcttcctcagcctttcttgaccttggttttaaccaaccacggcacaaaatttaagtttttttccagaggatgttcttcaacttggaacatcttgtggagaaagttggtggcagtgtctgaaacacatcatttcttacaatgcattttttcacttctttggaataaaatatctgtgttattaaaaaagtttgatagaaaattgatgtaactttatgtgaccaaatacgacgaaaatctttaacaaaaatgtcactaagtctgaattctcaacgactgcattgtattccaaagttatttttaaataaatgaataaatacacaggaaacaaagtcaaaaaaatgaatttagtttctcttggtattaaaagatgttagcaataagatactggtcttttaatcaagaataatgaaaatttaaaaaatacattttttcaaacacaatttggataatagaggtggaaaaacaggagacagacaatgcttttgatgtgcagaaaagaaaattccaaggatcatgggtgatctccctgtgtttcatatgtcaaacaagatataaaatcaaatgtccattttgtttttacatcttacttgagttcctgaagctactttctctttgtagtttttgctttggtacactcagattttggtgaagcagttcttatggaggaattaagagttgctgatttcaaccttctttggcttgtagccctgtcctgcttctaagactggcaacaaaagacgctgattccttttttattccaggtaaatattgtttctgggatagtccccatttccaaagctatagctagatatttataaccctgttcttgatggaccagtttcatgtttcaaaacccaaatattcagtgaaagtgaaccttaaatgttaatctgatttaacaaatgtcagacttcacagagccgctttggaaataggaacaatgtctcattcctttgaacccacaatgactgaaacctgagtccatggctcttctgtcaaaagagctccaggccatcacctgattgtttcctaatctttaccctttaaagtgattttgtcataaatgaattactgtagccctgaagaataatccacagtttttaccaacttgtaaaggacagtttctgtacacctatggaaagaaacaggagaagtaatcttcaacaactcttctcctagtttgaaagttactgtgggtaaagatgaaagtgtgaggcactgactcttgggtgtcagctctgctgaatgggccatatgtgatggtatttggtaaattatttccccaactgcacctgcaaggatcataaaaacggggtattgttcagtttctctgttccgccaggctgagctaatttttgttttgggttgtagcacagtgtgagggtgcttattgccctgctgacagtaatatgttgcagcatcttcagcttccaggctactgatggtaaaggtgaaatctgtcccagatccactgccactgaacctcgaggggacccctgagatggactgggaagcatacttgatgaggagctttggggcttgatctggtttctgctggtaccagtataagtagttgccaatgccttcactggcctggcaggtgatggtgactttctcccctggagtcacagagaggaaagctggagactgtgtcatcacaacatcacccctggaggctgaaaccatacagcaaacattagcacaatataagcatctgcttaatgaaatcaccactaatctagtagcacaagatgaaagaatacgcattacttaaaaaaaaatcacatttaaaaacaagccaagttccatatggtgccaggttcctaattaagaaaattaatggttcaaagaattagttttagctttttctaaatattctcacctggaacccagaggagcagaagccgcaggaattgcaacggggacaccatctcagtgttttgacttcagttttgctgaagacacatctaggagaaaaagcctcttataagatactgagaggcaggaccacttcagatgtgggaggaaggttacatgcaaattacgggaatgtcctgttgttttaaatacacagacatcactgttgtcaggagagcgccctccccgccccttcggggaatgtgagaggcgccctctgctggcacctgcagatgagcgccgctgaggccccggcagggcttgaccagacccagggcccagcctcagagtgaaggaagagtccatcgcagtctctgggaggctctgcagtcatctggggtgaacagcagctcacatcctcagtctcggcacagggctatcttaactttcctgacaacacattcacaatgaggctgaagaaactttgatcctgtggacgcttcacaaagcatcactccatacaacacgatattgatgtcatcgtggtaactagataggataagcagaaaataataaggactctggattttcagtgaaagcacatgaagaccagagtgtgggattcaaccctacaaaagttaaggacctgtcacattggagaaggtatcagggatttagtgaaggaacatgagtagcgttggctcatccccttcaaggtaaggacaaataattgtactttgcagctccaatcactgagaatgcagcacagtgttggcaaggcctgcttagagtattgacataacaaatcccacacttgggtctactccaccaccgcacttataagctaacttggaaggctgctttttggagtgggctcagaaaaagagaagattttgaggaaggttttgggctttgacacaagtagctctgtcacttgagccatgtgatccagaacattgttcggtgctagatgcatctgcattagatgggaatacttcatgaactctcttgcaaactccaataaaactcacggcataaatccctgggattttagagaagaccaagcaatgaccagataacaaataaaaaatttcttgttcaaaatgcagaatatcactacataatggtaggtagtcccatgaggcatttaaaaagtatgtgactgaactgcccctcataagtggaggaggccagtctcaccaatttttagggtcaggtgaggctcagcaccattcaatattaggatgaatattaggtacttttggggtttggttcaagcaggttcagaggctgtgcttcatttacatgaacaggtgttcctgttcctcctaccatttttctctcttactctaacacctttgcatcagctcactccagtgacctcatgagttttctcaatcagctaatagcaaggggggaaacaaaaaatgcaaacaaataaaagaagaaaaccaaaacaacactaagaaaatctaggctttttgaatgggttagcatcatatatttgtgcaagtaaaagtaggctgctcccacattttggccacaatcatgggtggctgtgaggtgttaccttgagttagcagatatttgaggacagcatgtagtgttcaacttagtgtggagagagacatgtactgagtcaagtatatgcatgaattagtgatagctggttggccatagtctttgataaagaaaattggaagatcacagagaagaagctctagaggagaggtatgtggatgcactcatatgaataagaaattacatgtgcaaaattttatttatctctgcaaaaagcagagaatatcttccacagtaagacaccaaacaaccaatcatactggaaggctcatccacttgtaagcagattaacggaactcagtcttttctcttaacttccacaatatttgcataatagagtctgtaatgaagtagccatcatagcctgaacagggctatgaatgagtaaaatgacatgaaccatgcctcacaacaaccatcaccacttgtgttgatcccactgttgccacttctgggtatccaacttctcagcagcagagacaaatatcttcaacaagtgggtggttatttgggatatcagatcactgtcccctggaggtgactgtgatgcatcctaactaggatcctcctgtattctagatgtatgtttacctttcctgcccatagacaattggctatctcagtgctctgagagcattttttgtattaatatgggaatatttcagaaccatgttcctacattgtggggaaagaaacaaaataatagccacgtgattatagcatccattggttctaccaaatatatcacgcaaagaaatccacaagggtataatattctgcagattttagatgctctccctcaaggtgttctgaatctttaaatcaatgaccatagtagaatgaagtaatggttcaggaagccaagggccaggagtacgagcagactctttagtcatcctacacaggaacccagctggcggacatgtgtgtccagtaatgcaattttaggccctgttggccacagacatctactcctggatatccgggagtatgtgcttctacttgggactactgtagataatcctgaagctaaacctcaagctgtggtaaagcagggttcctcatgccagtatacaagaaggcaaccaaacatacctatttcagcaaatagtaaaactatcatgaaaagatcgttttctgctacatttttggttagaggaggaatatatctgggaatatgtctggattgaagaacacacaccataattagatgataattaatcctcaactaatgtaaagtaaaattacaaataattaaaataaggtaggaaaaggaaaatatttctaagtggctccattgctccagctctttcaggagaagtgccactatagcaaaaaccttcaaggcttaaaaaatgcatggaaattttttagttttgtgtcttacaatatacttccctcagcaacatgtatcatgtgtgttcattttcaggtgttcattcacacctgaaagctatgaatcacccttttcaaggtaattctagccacatagtagaatcaaatgggaatattttaaaagtattgctgcctgctcttatcctagcctagttggctagaaatacttgactggagttcaggcacccgcatgtttaaaaatcttcccagaatatttatagatgcaagtaggatagaaaaccttttatctaattggctctttgcctctgtagtccagcagccacagcattttcatgaactgggagcttgttagaacattcaaaatatcacgtccgggactataacacaacatcgaaaaggtccatatatcaatcaaattgcagtttttataccaaaaattaagaaaatctctacttgaatgggaaaggaaaactagtagctatttagcccttatatgacagatatgttaaaattatcttaaaaggattttaaagcagccatcataaaaatgcatcaatgaacaattgcaaaaaaagcttgagacaaatgaaataatggcatcaagaatgaaatatgaaattttataaaagaaaaatggaaatttaagaattgaaagatacaatcactgtatgagcagctcagtgtatggcctaatagcagaaaagagtagacacaggaaagtgataatagataatagataataattatctactagtaattgggtaattactattatccaatctaaacaacagtgggaaaataggccaaaaggaaatggatgtagacacaagataaaaagaaatctatggtaaggcatatcctagtcaaacttctaaaaactaaacacaaagaaaatctttaaaggcagaatttttaaaaaactacttgtaaactttaggggaaaaatgatttgaatggcagagaattccttctcagaaactatgaaggttagaaggaaataacaccatttcaagtaatgaaagaaaagacctgccaacatagaattctatttccacgacagctgctccaagatggctgactagtcacagccaggaggaagagcttgcaccaagggactgggacattagaaagactggtgcacttctagcagatcttcagagggaaggcactgagaatagatgaagggaagacgaagatgctgggctgaagggggaggaagctgggaacactgtgtggggctaccatgtaccaggacacattcctggctcccagtgactcctgtgatagggatgagttgaaccaacaaagagcaacttaggtgtctggaatcccttgaacaccaaagacacttgatttgtcagggagagctacttagagaaatgatagggacagaattccagccagcacagagcccagagtgtttggtgcaggagtgtctgtagtggaatatggccagggacactcatccccctaggctcaacttgctcccacaggagactttagtcctaggggaactgtatgacataaactctgcagagtgatcttgtccatgaaacagggccaatatgatctgactgtcccttgggctgctactgtctcccggggccacagccttaccattcctgcttgcattgcagcccctaggtacatcctgggggcccacatcatagctcctgcactggcagattgcatctgacagggaaaatgctccagcagagtggctcccatggacatataccaggcctccagtgttattccaccactgcagcatcccttgtgcacagactcccctgtgccactttgtctgtgctgacactgttagctggcacaaaaaaaggcatagtgaaaagtgaacacacccccaccttgagtggccaccactgcccacgtgaacatgcacagagtctgcatacagtcctgtgcctaccaattccccacccctgtgttaatacaccaccagctcaaacgtgtgtacagtcactggcaggccccactccccctatgagtcatgctgccactgtcactgctgaaaatgcttgcatggaagctggcaccccagcacccactagcaccctgccacagctgatgagtgcacacctgtggctgccattgctgctgacacatacaaacaaggatggatcccactgccaccaccctatgaactgctttggctggcaccacccacagaagtgttgtgaccagcggtccaagagcaccttggcccctccagtgcatcaggttcttaaccttgaggagccagagaacaaaggtgggtaccaatacctgtccccaagggttagagcatgcagtccaagagtcctgagctgtgccttggctccataaaatcttccagaaatgaagccaattgactgaacccagcttataacacaatcaaaccttcaaggttatcaaatagaataaaagaaaaaaaaaacaagaaccaaatcaaaggacagccacttcaaagactgaaagcccacaaagatgagaaggaactagcacaagaactcttaaatctcaaaaagacagagtgccttcttttcttcaagtgccagactagttctccagcaaggggttcttaactgggccaagattgctgaaataaaagaaacagaattaagaatataaataagaacaaagatcattgaaattcaggagattgttgaaacctacctaaggaagctaaaaatcacaataaattgatacaggaactgacagacaaaatagtcagtattttggaaaagaatataacttaccagatagagctaaaaacacaatacaagagtttcataatgaaatcacatgtgttaacagcagaataggccaagctgaggcaaaatctcagagctcgaagactggctttctgcaataagataggcagacaaaaattttaaaaaaagaataaaaaaatgaacaaaaccttcaagaaatatctattactcattggcatttctgaaaaggataggggagaatggaagaaatctggaaaacatatttcaggacatcatccatgagagctttcccaatttagctagagaggccaacattcaaattcaggaaatgcagagaaccataacaaaatacttcacaagatcatccccaagacacataatcttcaattctcaaaggttaaaatgaaagaaaaaaaatgttaaaggcagctagagagaaaaaacagatcacctacaaagggaagccatcagactaacagaagacctctcagcagaagagactgggggcctatatttaacattcttaaagaaaataaattccaactaagaatttcatatttggacaaactaagcttcggaagcaaaggagaaataagatccttttcagacaagcaaatgctcaggaaatttgttaccaccagacctgcctaacacaagcttctggaagaagcactaaatatggaaatgaaacactgttatcagccactataaaaacacactgaagtacacagaccagtgacattataaagcaaccacacaaacaagttggcaaaataacaggctaacagcatgatggtggtatcaaatctaacatatcaatactaaccttgaatgtcaacaggctaaacgccccacttaaaagacacagggtggcaagctggataaagaagcaagaccaaatgttatgctgccttaaggagacccatctcacatgcaatgaagcccatggactcatataaagggatggagaaaaatctaccaagcaaatggaaaacagaaaaaaaacaggattttaattctaatttcagatgaaacagactttaagtcaacaaaaatcaaaaagacaaagaagggcattacataacagtaaagggttcaattcaccaagaagatctagttactctaaatctatatgctgccagctcaagatcacctagattcataaagaaagttcttagacactttcaaggagacttagattcccacacaataatagtgggagatttcaacaccccactgacagtattatacagattataatctgtataattaattttctgaggcagaaaattaacaaagatattcaggacttggactcaaccctggatcaaatggaccttatagaaatctgcagaactcttcaccccaaaacaacagaatatatatattctcatcaccacatggcacatatgctaaaattgaccgcacaatcggacatacatcaatattcagcaagtgcaaaagaaccaaaatcataccaacctctctcttggaccacagaaaaatgaatgtagaattcaagactaagaaaataactcaaaaccatggaaattaaacaacatgctcctgaatgacttgggtaaataatgaagttaaggcagaaatcaaaacgttctttgaaatgaatgagaacaaagatacaatataccagaatctctgggacacaggttaggcagtgttaagagggaaatttatagcactaaatgcccacatcagaaagttatacctcagattaacagcctaacatcacaactaaaagaactagagaagcaagggaaaaccaattccaaatctagcagaaaacaagaaataaccaaaatcagagttgaactgaagtagataagacacacaaaaaaattcaaaagatcaatgaagccagtgcctgtttttattttgaaaaagctaatgagataaatagaccactagctagactaataaagaagaaaagagtgagtatccaaatacataaaattagaagtgacaaaaggacattatcactgaccccacagaaatacaactaaccatcagagactactatgaacacctctatgcacaataactagaaaatctagaagaaatagataaattcctgggtgcatacaccctcccaagactgaaccagaaagaaattgagtccctgaagtgagcaaaaatgagcttgtaattgaatcagtaataaatagcctactaaccaaaaaaatcccaggtccaaatggattcacaactgaattctatcagatgtacaaagaagagctgttaccattcctactaaaggtattccaaaaaagtgaagaggaaaggctgggtttggtcactcatgcctgtaattccagcactttgggagtccgaggtgggtgaatcacctgaggtcaggagttcgagaccagcctggccaacatggtaaaaccccgtctgtactaaaaacagaaaaattaggctggcatggtggcatgtgcctgtaatctcagctacatgggaggctggggctggacaattgcttgaacccgggaggtggggcttgcagtgagccgagatcacatcactgcactccagcctgggcaacagagtaagactctgtctcaaaaaaaaaaaatatgtatatatatatatatatatatatatatatatatatatgaggagggactcctccctaactcattctatgaggccagcatcataccaaaacctggcagagatgcaacaacaacttcaagccaatatggttgatgaatatcgatgtaaaaatcctcagcaaaatactagcaaatcaaatccagcaacatatcaaagagctaatctaccatgatcaagagactttatccacaggatataagtttggttcaacatatgcaaataaataaatataattcatcacacaaacagaactaagcacagaaatggcttgatcatctcaatagatgcggaaaagacatttgataaaatttaacatccctttatgttaaaaactctcaacaaactagatattgaaggaacatacctcaaaataataagagacatttagaacgaagccatagccagcatcacactgagtgggcaaaagttagaagctttccccttgaaaactgtaacaagacaatgatgccctctctccactaatcctaacagcatggtgttagaagtactgaccagagcaatcaggcaaaagaaggaaataaaaggcacccaaacaggaagagaggaagtcaaactatccttgctgcatatgacatgatttccttttttttttgagacagaatcttgctctgtcacccaggctggagtgtcgcagtataatctctgctcactgcaacctccacctcatggagtcaaatgatcctccatcctcagcctcctgagtagctgggattacaggtatgcaccaccatgctcagctaacttttgtagttttactagagatggagtttcaccacgttgaccaggctggtctcgaactcctgatctcaagtgatccacccaccttggcctcccaaggtgctgggattacaggcactagccactgcgcctggcctcacatgaatatatctctagagaaccccatagtctcagcccaaaagctacttaagctgacaaacaacttcagccaagttccaggatacaaactcaatgtacaaaaattactaatatttctgtgctccaagaagagccaagctgagagccaaatcagtaatgcaataacattcaaaattgccacaaagagaaagaaaatacctaggaatgcagctagcccaagaggtgaaagatctctataaagaggactataaaacattgctcaaagaaatcagaaatgacacaattaaatggaaaaacattccatgttcatagacaggaagaatgaatttcgttataatgaccatattgccaaaagcaatttatatattcaatgctattatcattaaagtaccattgtgattatctacaaactagaaaaaaactgttttaaaatttatatggaaccaaaaaagagcccaaatagtcaaagcaattgtaaacaaaaagcacaaagctggaggcattacactgcctgacttcagactatactacaaggctacagtaaccaagacagcatggtactggtacaaaaacagatacatagatcaatggaacagaatagagaacctgcaaataagactgcatacctacaactatctgatctttgacaaatttgacaaaagcaagcaatggagaaaggattccctattcaagaaattgtgctgggataactgggtagccatatgcagaagattgaaactggaccccttccttacaccatatacaaaaattaactaacgatggattacagacttaaatgtaaaacccaaaaactctaaaaatcctggaagacaacctaggcaataccattcaggacatagacatgggcaaatatttcattacaaagacaccaaaagctattgcaacagaagcaaagattgacaaatgggatttaattaaactaaagatcttctgcacagccaaagatactatcagcagaataaacagacaacctatagaaagggagaaaatgtttgcaaactctgcatctgacaacagtttaatatccagcatctataaagaacttaaacaaatttacaagaaaaaaatagctccattaaaaagtgggcagaggacatgaacagatacttttcaaaagacttacaagtggccaacacttatatggaaaaaagttcaatatcactgattgttagagaaatgcaaatcaaaaccacaacgagatatcatctcacaccagttagaactggtattaccaaaatgtcaaaaaataaatgctggagaggatgtggagaaaaacgaatgcttatatactcttggtgggagtataaattagttcaaccattgtggaagacagtgtggcaattcctcaaagagctaaagacagaactaccattagacccagcaatctcattaccgtgtatgtacccaaaggaatataaattgttctattatgaagacatatgcacgtgaatgttcatttcagcactattcgcagtagcagacatggagtcaacctaaatgtccatcagtgacagactggataaagtaatgtgattatatacaggtcagttttgcctttaatttgttgctcattattgtgagccttaacatacttctttgtgaacttgccactgtttcaatataatattgtaatctttatttcagagtttattgcaaacatttatggttaagtatttgatatattttatagagtttacttccttgttgcttattgaaatttgattttataattgtattaaaccaatttaaatatatttaaattcaaacatagaaataaaaaattgaagtgttgatatgtctaacaaaaagccaatgcacaaattaccttaaaagattaattaaatgtctgaatcactaatttaataatattttcatgtttaaaatgtgtcaaatatatttttgagtcctagatatgtgaaggttttgtgcaatgtactgtaatatctgctaagacacactattcttttcttatcaggtgaattcatatttgaactgcaagttaatttcttgaactgcaagaaaagaggcacctaggaacatatttgaaaatgcgtaattttaaagcagctaaaattatttattaattaataattattttctgagtttacatattagacaaaaaatgctactgagaagatatcactggtttttgctctgtaacagaattagttatatctcgaatatgttgccactcacctttcctaggcacataggagaaatcaacaaatcattgtctttttttactgaaagaggaggaccaccaaaatctgtcttgaccacagctctagaaggtaccttactaaacactgtatcatccttgccctattaagtaagtgcttgctaaattgcattctttttgtgctttgaattttcaataaatacattctgagaaaataatacaccgattggaatgcttgactattcaaaatttcaggtatatactccattattttattggtctttctcttatgatccaggcagcacaggatcaggtcttctctagaactcactgttgtatttttatgccaagagcttcagtagacaatcagcaaatgggcttgcagttggcaaaaatagttacatagagctgatgatttctcatagagacgagggtgttaataggaaaatatttctttacttattttttcttggtgaatcaataataaacagagaacttattttcggaaataaattcagaaagtcaagtatctaaatctggtagggatgcccatagaatttttataaggaacatatataattttatttctaaaagtcaatttaatgttattagctagtacacgattcaaaggacaatttaaaaatcaggtaactgtagtaaaggcaaatacatacttttgaatgaataaataaatttagaaaagtcaataaatataaaaaccatgtgcaaaaagatcataccagcaacaaacaaattggagatggaattgtgaaatatgtgatctgcccacctgccaaagtgctgggattacagactttagccactgcgcccggcatttttttttttttttttttttttaagacagtctctattgcccaggctggagtgcaatggcacaatctcagctcactgcaacctccgtctctcgggttcaagctcttctcgtgcctcagcctcctgagtagctgggattacaggtgtacaccaccacgactggctaatttttgtatttttagtagaggcaggatttcaccatgttggccaggtgggtcttaaactcctggcctcatgtcattcgcctgcctcatctgcccaaagtatggggattattggtgtgagccactgcggcgggcctaagatgtgaagtcttgatactgtacaaaacattattaaaatgttaaagaagacctctagattgtggttttggtttactatccaaacaattataccatctacaaataataactattcgttttctttatttccagtactcatgtattttatttctttttcttgccctttatactagtaagaggtccagtacagtattatctaggaatgatgatactttacatcttttaaaaatatctaattccaaaatgaagaaaaacaatttttcagcatttaatgtgattgtgtgtgtgtgtgtgtgtgtgtgtgtctgtctgtctctctgtctgcctgtgtattctctaagaggtaaggaaggtatttttccatttctaattttctaggacatttttacataaacagggtctaaattttgtccagtgcttctttctataccaattgagacgaccatataccttttttcttctttaactatgtcaaatgtggtaattatattgatcaaatcttttaaatccttattatgttattttctgcttttctatcacctcttgagcataaagtctcccaccataacatggagttgactttttctttatttaatcaattttttatttatatacttttaagttatattttgggtctatatagatttagtattttaatgatttcctaatagattgacccacttatcattatgaaatgtccccttttctccttcgccttaaagtataagtcaggtttcgtcaattcagtttttgcatgatatgtactttccgttttttaattttcaaagtcattttatgatattattgcagtgtgtattttataagcagcataaacctttcattttaatcttgtttaataatttaaaaattttacttagagaaatttgtctgtttatgatgtctaaattattggtagttagagttaaatctaccatcctttttttttcagatttcctgctttcttgctttcctttggattagacattttattatatttttccttgcattaacttgttaaacatacaatcatttattatacagcagctatcctcaacttattacttcctagtaccaaatattaatttaccacttcctaaaatagagttagattttttaattccatttacactactttttcgtgttatttttcatgcaattcagttatatatgcattgcaaaattcacaaaccatgacatctatagttgtgcgcaaatattagtttgtatttattcctatacatatcctttccagtgtccatctcttatgtatctttatgtttctatttagtcttgcattccttctgttgcagaactgtctttagcatttcttttatagagtactactgatatataactgcctaatattttgttgttttacaaacagtatttatttgcacattcattttgcctcatctttttctttccttttcaaaggccccaaagatgttaaattacttactgatatttattttccttggaaggattgagttccttttgagttgtttttcttacatataaatattgccatacaactacatactcagcaaagataatacatagatatattaagtatacttgccattggatatattttcttggaataggcagccatctgccatatagcttatgtccttaatcaaaagcaggatcattttgatttaattcaaaccatctacttctactatagcatgatgaaataatacatatgcccttttatggatcaaaataatattaaagtactattgtaaatgtagtatatttaaagcatatatgtgtgtaatttaggcatatgttactggaatactgaattcagtattccatgtttggtattcagtatcaaatattttaaacactgacatgatcattatcatttctgcagttgtttttctccttcatttccatgtgccatgtgcatttattgatctagatgtgaatgttttgcaatataatattcaaagtgacatccccactttgtaatttaatagaacaatttattttcagtagtgaagtagtgaggaataggccttagaagatggacacaagaattgcaataaatgcaggagagcaaaaatgaacttaaaaaatcatgtttgttataacatcagagagttgtggaacaaataaagaacagatagcctaaaattccacagaggaaagatgcctttgtatattgccttgtgtcctcctgtcactttgtgtcttagtgaaatttgccaaatacgagcgtgattggagattctggtttggtccaggcagaagatctctacaagagtggggaattcatctcacctttggcagaggcatgtacgtgccttacagattatggattatatggcacaagtggagcccttaacaccaggatgaatttttttttgggacatttgctgaggcctgggttgagaatggtagctgggtgggttggctagagagacacaatgaaacctcctgcattctcctgagttctcccctaccatgctgccttgattttcctttatgtgtgtctgaaatatgggctttgggctcccaccactacacctcctactcatcttcccagcccctgcactgctctggtcagcatcatctttattttaactataagctttcttgaatgatcctttctttctcaaatcattcccaggtaaatgatgggggcagaatctacttttccaaggtcttctacatcctgctggattgactaggaatgtgtgatatgacctgaggtacatttggacagggacttctctaaacttggagtcactaaagactgtgtgatgcaatacttccctgggagtttgccattgcatcagagcacagttttgaactccacgcaggattcccacaactccccaagaaatacagcagagctttcacttgggttcatatatcaactccaacacaccaccactaacatagttaacagctgccctcacattctcatttactgccctctgcccaaagtctatagattattatttttcaaggggcaaaacataagcttatatattattttatattaatccagattccattgaatatggcatacatttttgactatggctacatttttagtccttttttcttttgtcttttgaaacttggatatttatttttaaaacacagctttggatttcatagaattttcttttcatttcaacatactgtgaataagattgttcaaagatttttgtcactaggtctttgtttttgcataaacttaccaaaacatatctagcagttacaaagtctagaatgtaaatacacgcaagcactccctgaaaaaaaaataggataaaatgctgtgcttcctgctgtcccagagagagatgtatgttaagaaaagtgtaaagtggaaggtagaagatgggagagaaactgttttagtatcaccaaatcttgtcaaggtacatgtacactagtaactgctaaaccaaatcaaaaccaaaaatatattagttttgtattgccactaatctgtttcatttaggtggctgtcaggctgaatgaatttagttagtgaatgaacttaggcaaggcagagaggattacgatgagctttgattcagctttcccttgcaacatgactggttgttcagaggcacttgacctccctccattctcctgcaagttctgccaggccaagactcttgcaactgatggggactaaattgtggtacctgagatgtaaccgagatattgatggtcaagagccctcagctgtaatgtattctcctgaattctccatcatcttcctctttactctcccaagataatcgacagtgtctgctttccagataaacaacacatttgggcagctgaaccacagcaagaagggaggtttctgttcagggttgtaccactgtgttaggaaactgtgtagcttgcatgcagtaataaaccccaacatcctcagcctccacccagctgattttcagtgtgaaatcactgcctgacccactgccactaaacctgtctgggaccccagaaaaacgactggaaaccctataaatcaggagctgtggagattgccctggcttctgcgggtaccaatgcaaataggtatatccattactatgcaggaggctttgactagacctgcaggagatggaggccggctctccagggttgacgggcagggagggtggagtctgggtcatcacaatatctccactggatcctgaagtagtgagagaagtgcaaggttatgtacaaatattgggaaccattgaaatgatattctttctgttatctactttatgctaagtgatttttttgtgtgactttggttcatacccctaaacatccaggcataaaaagaaccaacattcacaaggcacaaaagagactcaagaagtcacctacactattatcctcttcctgtgtgacactcttcatgagagcacaagtcctttgtccttctaggatatgaagtttagaactataagagtgaggaatcttctctttctgactcttgcagttctaaactttatacaccttttcttgcaggtcaagatgtgcatgtggacaggcagtggggcccccagagctcaccctcacactccattctcctcccttatctcccttctgtccttaccaggaacccaaagcattagcagccccaggagctgagcagggaaccttattgtgagaaggtgagctgaggagttctgatcagtcaaggcaaggttacagctgagcttttatctcagactcacaatggaaggtcctccctaggggacagtatgcaaatcccctggtgggtgcagtggggtggaaagagccaaggagagtatggggacatctagtgtgagcacagtgacataatgtgtcctctgtgtttggagggaacctaataaagtttgtgctgcctgagtggaaaaagggacatatttaatcatgttcttctatttcctctaagagatttctacattgttttcactttcccagacacattttacacttgtctttaataggctgagtttccataaatatttggttattcttatttgtttaattttattatatatatacacacacacatacatatatatacacatatgtatatatgtataaatatatatatatttttgatatatatatctatatataaaaatatatattattttgtgtataaatatatatgtatatattttgagacagagtttcacttactctgtcacccagactggagtacagtgtcaggatctcggctcactgcaacctctgcctcccaggttaaagcgattctcttgcctcagcctcccgagctagctgggattactggcatgcaccaccatacctggttaatttttgtatttttagtagagatggggtttcatatattggccaggccggtctcaaactcttgacttcaagtgatcctcctgcctcgacctcccaaagtgctgggattacaggcatgtgccaccacacctggccagttattcttatttattattttcatatttattttagcatctaggtttttaaattagtttgattttagttgataaaatccccagagtaaagggcacaaatattaagcgtgtaactgaatgaaatttgtgtatattcactgtcaaggtggaactatggaatatagatttttttttttttttttgagatggagtcttgctgtgtcgcccaggctggagtacagtggcccgtgatctcggctcactgcaagctccgcctcccgggttcaggccattctcctgcctcagcctcccaagcagctggggaccacaggcgcccgccaccacgcccggttaattttttgcatttttagtagagacagtagagaccaatatcatattccctcagtaatgctctgagctgtactccctactagcatgttcctgtgaactcaggaactgctcttctagaccccggctttctggagagcaggtgagggggaggcaccggggaaaggtcaggtcattgagctgttgggtgtatgttcctgctgtgcaccatcaatgccactttcctcttttacgcttaagcaatgaatggggacatcatcctgacccagattccagcttctctgttgggattggtaggagggagagtcttcatctcctggcaagccactgcttacgtatatggaaaagtattttagattctaatgaaactggacaaagatttgaaatccgattttttacatatctaacttggccctgattgtctcagcctggttcagcaacagaaggagtggaataaattgtatcagcatcagtagactggagcctgaggactccagggaacattcgcacacaagactaggagaggccaaatcacagcagtctagcctgtgcaccgtcctcctgtggcctttcatgagcctgattttttagagaaacttgtttacatccagcttgccaggatcaaattctagagagacgcagatttaaatgtaagttcgcatctttttttttttttttttttttttcctgcatggatgtgctggaatgatggaggaaggagttatggagccaggaatatgagggtatcttgaagattaaaatcaagaaatccgattttctcccctggagcctccggaagaaatacagccctagtgactccttaattttagctcagtaagacttctcaatccagaattgtagataataaatttgataggatttattatagataataaatcatactgaatgcggtataattgtggtaattagttgccctagcaataggaaactgttacaggcataaggcatatcttttatctttctaaaagtgtgattgtccttcttctcctaaacatttccattgtgttatcatttggtgtcaattttgaccagaggcagagaacattttactgcgaggagagctagcaccagaattcttaggtggaaaatctcttgtgagaatccctttattaggtctcatatgatctgcatgtctgagatcctaggggtcagctctcacagcacaatgtgggggagcatgtgtggttatttgtttcttattatattagtaggactcgttagattttcaggacaggatctgagaggaaaggaactaaaaacaaagaccatatgatcatctcaacagatgcagaaaaggctttaaataaaattcatcatcccttgattttaaaagccctgaacaaactagacattgaaggaagatacctcacaattataagacctatatatgacaaacccacagccaacatcatactgaatggtgaaaagctggaagaacttcctctaagaaccagaacaagacaaggatgcttattactctcaccactcctattcaacatagggctagaagtcctagccagaggaggagaggaagtcagtctatctctctttgcatctgatataatttatacctagaaaaccctgtcttcactgcccaaatgttcctggatctaataaaccacttcagcaaagtttcaagatataaaatcaatgtaaaaaatcagtagcatttctatataccaacaatgtctatgctgagagccaaatcaagaacgcaatcccattcacaatagccacagaaaataaagtacttaggaatacagttaaccagggtgctgaaagatatctacaactagaattataataaactgctgaaagaaatcagagatgacaaaaacaaatggaaaaatacttcatgctcatggatggaaagaatcaatattcttaaaatgatcacatagcccaaagcaatttacagattcaatgctatttatatcaaactatcaacaaaatttttcacagaagtagaaaaactattctaaaattcatatggaaccacaaaagagcccaaatagacaaagccgtcctaagcaaaaatgaacaaaaccagaggcattgcactacctgacttcaaactatatactacaaggctacggtaaccaaaattgcatggttctggtacaaaaataggcacataaatcaatgtaacagtttagagaacccagacttaaagctgtacattataaccatctgatcttgacaatgttgacaaaaggtagcaatagagaaaaggctccctatttgataaatggtgctagcataactggccagccatatatagaagattgaaactggaccccttcctttcaccatatacaaaaatctactcaatatggattaaagacttaaatgtaaaacctaaaacttcaaaaacactagaagaaaatctaagaaataccattctagacaaaggccatagtaaaaatttcatgacaaaaactccaaaagcaactgcaacaaaaacaaaaattgataaatgggacctaattaaagtaaagagcttctacacaagttaaagaaactataaacagcgtcaacagacagcctacagaatgagagaaaatatttgtaaactatgcacccgacaaagacccaataaccagaatctgtaatgaacgtaaattaacaagcaacaaacaaaaacaaccccattaaaaagtggccaaatgtcatgaacagactcttcttaaaacaaaacatgcacatagtcaacaagcatatgaaaaatgctcaacaccactaatcattagaaaaacgcaaattaaaaccacaattaggtatcatctcacaccagtcagaatggctattattaaaaagtcaaaaaataacaaatgttgatgaggttgcagagaaaggagaatgcttatacacggctggtgggagtgtaaattagttcagccatggtgcaaagcagtttggagattcctcaaagaattttaaacagaactaccatttgattcagcaatcctattacagagtgtatacccaaaggaatataaattgttctaccataaagacacatgcacacatatgttcactgcagcaaagacatggaattaactaaatgcccatcagtggtagacagaataaagaaaatgtggtacatatacatcacagaataccatccacaactgcaacaaatacaagacaaagttcaggttattggaccgtagttggcctctactatattctcttttatgttctcattcctggagtctgcccacagttttaaaattctcaccctttggtaaagaaaaaaaaacctcacattattctgtgttattctagtggcatataagataaattctataatctgcttgttccagtttaagtttttgtttttaaaatccaacttttggaatttcaaatattatccttttttattagcaagaagtaattgaaatgaatgaaagagttttaacatcaggatcttctgtcttccatgacgtcacaaaagtctatttggaggtgcaaattcaagctttttaatgattgtcctcagccagctctccctgaggacagcttgtgtagaatgctcttttcactatttgttatgtgttgcaatggaaagagaactagtaaaaaggagaagaaggaaattggaaaagttgaaaaataccagtttctaaatactaccaaatactatcctcttaaaaatatacacaaaagacctaaacttcaagagatagtcaacacatgttgacacgaatctgtgttacttgtctggctattaagctatttgaagtctcattgtcgaatgtaggcaaggcagggaggattagtgtgagatttccctccactctccctcagtcctgtctgcttactctgaaggcacttgaattatctctgttttcctttggcttatgccatgccaaggctgtgggagctgacaggaccatgaatgggttttacctgatgtactgcggagtcccccatgggacaggtcattcagctgcaacctgttaccctgagctcgccaacatcttcatcttttttttttttttttttttttttttttttttttgagatggagtctccctctgtcatccaggctgtagtgcagtggtgtgatcttggctcactgcaggctccatctcccgggttcaagctattctcctgcctcagcctcctgagtaactaggattacaggcgtgcaccaccacgtccagctaatttttgtatttttagtagagatggggtttcaccatgttggtcgggctggtctcaaacttttgacctcatgatctgcccacctcggcccaacatcttcatcttatacagcagagattctgttgtgccactccccagataaacaacatatttcagcagctgggccactccaaacagggaggtttgtattcagggttgtaccactgtgggaggcacttgtgtaccttgcaggcagtaataaaccccaacgtcctcagcctctaccctgctgattttcaatatgaaatctgtccctgaaccactgctgctgaacctgcctgagaccccagacttcctgttagaaacttcataaatcaggcactttagaggttggcctggcttctgcagaaaccaattcaagtaagtgtttccatttctatgaaaggggctctgaccagacctgcaggaaatggaggatggctctccaaggaagagtggagtgtgaagtctcaggatgtgaacttggagggattttttttcccacaagaatccagcaaatgagaggataaccttacagcatccataaggtagaagcctatcaaacgtaaggacaacctgagactaagggtagccagggagagaagatctgagctggaaagggtgaaacaaatggaccaaaagaagctgaccgcaagacaggaagttcagaatcagggaagctgaatatgaatctgactagaagatgctcttgagagatttaaacttttcccatgttttatgtttctcatattgcaaatagtttccattgttaagagaatatgtttgtacagaaattcagcttatgacgaactttgaaattccaccaaagagatcgagggaacgatgggttgttgcttttcaggactacaaatcagcctgtctttgagatctgacactgtctattttgcagtggaatctgcgatgaggctgtgaattgggcagtgaagtcagggcagggctgactgtgctctgggtgccacggataacagggacattccttcagggccggtgatgctgggaggctgaggggagagactcagtatgaagccatctgtgagcctccttggcaatgctatctggaccctggtcatcgaatgagccactccaagcagggagttttgccttcaaagttgtatacatggatgcccgtggatggccaaacataggctcaggttgagcagggaccaagatttaggaaggagcaatatgaggctgacctgatgctccgaggtttcagcacaatcttaagggatcatacagggagagaaaggggtcacaaggtgtaattttttcatttgatgctgaatatacctcttcagaccatttttctaccctgtatgtaactactggtatacatttaaccaaagccactgctactaatgatcatttcagtcattgatagtgagaggtgaggccagctggacttcctgggtggagtggggacttcttacaagaggattgtaaaatgcaccaatcagcgctctgtaaaacgcaccagtcagtgctctgtaaaatgcaccaatcagcaggattctaaaagtagccaatcgtggggaggattgaaaaaagggcactctgataggacagaagcggaacatgggtggggacaataagggaataaaagctggccaccccagccagcagtggcaacccgcaagggtccctttccatgctatggaagttttgtcctttagctcttcacagtaatccttgctgccgctccgtgccatctttaagagctgtaacactctccacaaaggtccgtggcttcattcttgaagtcagccagactcaccagcaggaaccaactccggacacaatagcctgtgtgcacagatcccgagaagctggaaatctggaccaccattcaatgtatgaggagacatacacataaagttcacgttttctccatccacaggaggtgactgtggatgtgagtttgagtctgactagaagacggtcttgtgagatttaaactacgatttttcctattgaaaagaagaaacacctttttttaccctttttgcaacaaatatgtattgagccccaacagtcatgcattgtgctaaatgaaaaatttaaagatggcacaaaagagaaaaaaaaaaggaagagaaagagagggggggcttcaaaatcttgtataattcgttgcaaatactacgaacacttccaggtatgtttattcataaggacagtggatgcaactggcagaggctgcagttttgcagtggagggaaactctgtatacagaggcaaacttcttctgccatggccacagcaatcccttgttctaagcttaggaagaaaaatctaaaaaaatgaaattcacagaaatagcaagtagaatgctggttaccagagactgcattgttaaagggtacaaaatgtcagtctgatagggggactaagttttggagatctgttgcatagcatggcgacattattatatagatgtatttctggcaggcttgattgcctattacatggtaagtcagcatacactaagacactgggggctgctgcagagaaagagatttaatcccaaggcaattaaatgagaagacaggaggaagcctcatatctacctccccaagcactttggggttaaagattttaagtggttttggatggagagagagattggttgaagaatgaaggatgaagtcatgggactgggaggtgaagaaactgctttcttatgttgactcggttctttgggaggggggtggtctttagacaagttggtgtcagctattctactggaattcaggatctggtaaatatctcaaagattaggttttatgctcataatggtgaaggtgttatatttgggaacaatggggcgttaatggtctgtatttattgcaacttgacttttattagtgagaagctaagggaagttgctcagaatgttgtctgattaatgcttaactatatttcagtctggaacctggcatactgttcttgttaaccttatgacagtggttttgtagttaataatactatattctgtatttcaaaataacaaagtatagtcaatgttctcaatacaaaaaatgataaatattggaggtgaggactatgttaattaacctgatttgattattcgacaatgtatacatgtatgcatctcattgtaccccgtatgtatatacattactatttgtcaattaaaatcaaaataaaacttttaaaaattcatgtagccattgcctggaataaataaagataaatatgtgtgcacatgcataactatacccctgtaaaaattggagctacgaagtccagtaaaatattgaatcacagatatttctgtctttagctttagtggaaatagtcaaaatactgggtcccaacaatagttatattagtcctttcttcccatatccaccaccttgttattttttaattcatttgtaatacctttagtttcatttactcttgtttgtagcccatttggatactctcatctttcttgatttcaattattttcaaatatttgtagtataaatagagtctccaaagacataaattcacaaaaacaaaaaggtaagctcagagacgtctcgccttccaccccttctgtaccactctcatctcatcccttcaccctgttaccagccccttcctcttatcactccctgccagcctcactctgtctatcctctcaaatttgttgttttcgtttacggttctgtttgtttttaaatctcctctgctttcttacttggaaggtaacacggtatagatatttgttggcactttgcttttttgtatatctgagaaataacttcctttcaattcatagataccttcttccttttgacagctgatacatactccattgcatgaatgttccatagctatttcaacaaaatatttatttatgaatattctgggtggtgtcaacattttacaaatcattacaattaatgttccaatgaataaccttgtgtatatgtatttttgtagtgttgaaggtgtatcttcagagattcctaggaatgggattatgggtcaaagttacacattaagatagttttgtagatgttgtcatattctccttcttaaaaaggtagtattagtttccatcctcacagctgttaatgagaaatcctgtttccctataaccttgcctaaaaatatggttaatattttttggattttcttaaaccagataatactacctcaaagtagtttcaatttgcatttccctcattattgagattacacactttacttgtgtttaaatgctatatgtatatatcttttataatgcattgtctgttctcttttcttcttttttctattggatttttgatccattatcttaacttttaatagagttgtttcatattagaacagtaacagtttatttgtttaatatattaagaatagtttctccttgtttttagttgtcttttgattttatttttgtgtatgcgatttcatttatttacttacaatcttttatctaaaaattcaatcatatttggaacaacatattttgtttacagtgttgatttattttatcctaatttgttttttagttctgtattattttattataattgagtaccccagagaactacaacctgcatccttggcttattgtgttttacataatttagcattttacgagcttccagacctggatcttaagcctcatgatgccccccgcctcggcttcccaaagtgctgggattgattacaggtgtgagccaccgcgcccggccgaagggacatattttttaatgtccttctgtttctctaagaggtttctaattatttttccctttcccaggcatattttacattggtctttaataggctgagttttcataaatattttctattctatttggtatttttacgtattattttaagtgataaaacacccagagggcacaaagggcacacatcttcaaattgtaactgaataaagtttttgtgtattcattggccagatggaactacagaatatttaccttctgctgatgcttcctccatgcaccttcctcttcagtaactgcttccccatctcaaccaaggtaattgtcattctgacatcgaacacagtaatttgggtttttatgtctttaatgtcatataaattgaattgtgtgtttttttctagctttattcttattgtttactactttcgagtccttcattatagactatgggctcaaaatcccacctgctgtaatcttctgtgattctgaaagatttcctcttgaatttcttataaggcagagctgctattaatgaatttattctgtttatcaaggaatatttttagttctgaagaatattttcaccagaaacaaaattgctggttgtcctctttcatttccttttagtatttaaatatctcattccaatctcttccagcctccctcggtcctaatgaaaacttagccaatggcattattgttgtgtctccatatgtagagtcagcttttagtcctgacacattcacaaatttctctttgtctttcaacatttttaagtataatgtattttgttattaatcttgtattatatcctgaaagcgtttcattgagtttctttcatctatagattaaattacctttgtggttcattatttttgaaaagctgttgtcattactattccaagtattttttgatcactttctctctctctgcttttttgtgactcgctttacacacttgttggtatctttcaacctgagctgtaattctgtcaagtcttgcgcattttttcttaaactcctttctttatttagattcaataatttctgtacatctatttttaagttcactgaatcttttgccatcttaaactgatgttggacttatctaatatatttttcagttgagttattgtactttttgtttctagaattctcacttgattcttttccatagtttctattttttaagagtttccatttgctgagtcattgtctttatattttcctctttatatctttaaaactatatgatcatagttttaagaataattatttaaaaatctatataataattgctttgtagtctttgctaaagctgatattcaggacgagtcagaattagctttcattgactgtgctttcttgctgcagttgttttgttttgttccctcaatattgatcatacttttctgtttctttgcaggattttttaatggaaaactgtatattttagacaatatattcctgtacctctatcaggaatatattctatttttcttaaaatttgtgagtttctttatagttacttccctgaacttacagtaagtccctaattcatggtggttgcacttaagatgttttgactttacaatagtgtgaaaattatttgtattcagtagaaacagtgcttccagtactggtacaactactctgtttttcactttcatataatattcaataaaccacattacaataagttataataaattattggtggtgataaatgaaagtgaccagtgaaatcccttttggaaggaagcctttgacaaagctaagacagctgttcctatcactcttcctacttggtcattcactaactttcttagttttgttatttattaaaacagagtacctctctgcaaatgaacagctgttactgagtcaattagttggataaataaatataattttctaccatttaaaatatttgtagaagtcaaatggatagctgcaccatgcactgagctgcgtttactggggagactgagaattattgatgccatgttaagaatcacactgtgagaaactaattctggaaatctgagattctggcggcacagttgaagagggtttggctacatctgcatagtaattatttccaaaaataagcacgttcgcaaatttttaatcttctgatctcaccatcaccatactgtcacccacactatattccaggtattcaggcactgtaagttctcattttggtgtttcttcaggttcactgtggccattctacatccttgacattcccatataatatttagattagcttcttaatttaaattggagtatactttaggattttgatttttcttatatgtaatcaatattttaatcttcgaagaattgacatttttatagtactgagacattcagtctttgaactgaatttctatttacttaggttttcttttatttttcaaaataatattctggagacgtcagtgtatttagtctattttttttaaataattgatactttgatgtttttgtaaaaggtgtgtttgttttataatgttaatttttagcatttttttcattatgcagaaatgaaattgatttttgaatctacgaattaataaattgatcttgaatctaacgattttctatttctcatgtcaattttaatagtttctctgtagacaaatttgaattttatctgcacacaatccttcatcagtgaattatgacagctttaattcttcttttccaattttgattatttgttgctattgttgttgccttatggctctggttgggacctttattgacatccactgacgtaaatctgatccagtggccattactgtgaaactgtgctttaaacctggctgtccatcttggtctgaggaataatgcaggaatcagagtctaaatatatcaagggattacttttttaagatccccaaaatgcccaagcagagaagagatgctaaaattgagttgtcattgcagcagctatctgtaaaggaagcagctggtataatctagtaaacaatgaaggtcttgcagaggtttttgtttcaagctgaatcactgtgggaggtgagctaccatactgctgacagtaatacactgcaaaatcttcaggctccagtctgctgatggtgagagtgaagtctgtcccagacccactgccactgaacctgtctgggatgccagtggccctgctggatgcatcatagatgaggagcctgggcgccaggccaggtttctgctggtaccaggctaagtagctgctgctaacactctgactggccccgcaggagagggtggctctttcccctggagacaaagacagggtggctggagactgcgtcaacacaatttctccggtggtatctgagattggaaataaaatagaaaagtcacccatgtaatctaaatcaaacccactgtcttcccagaagagccagaattattgctttatattgagctttaattattgtattgattcagcagagttgccaggtaacaggacttgagagggttttcactgacatgcaaaaccatcccatgttcccctcacctgggagccagagtagcaggaggaagagaagctgcgctggggtttccatggttccctctgggtcctaactgagcagttcctccccagagctctgacccaggcattgatatgggctctggactgcagggcggctgggagggacatgcaaagcagctgggggggcgggtgctgggcttccagcttcagagaccatctgcctcccctctctgcactcagcagcccatgcccaggtgatcaggccagaaaaggccgttggctcagcctgagggtagaacttctcccctgcggccacagaatttaacccctgtgtcctcttgtctcaccatcacttagattcagccacagaatgtttggtacaagtctgttagaaacaaaatagaaggctgtggtttcatttttctctttctgctccaacttgtgcccagtcagttccctaaatgcatgatggatcaggttgaaaggaagagtctattactactttatcttccggatatacttgtatttacttgttagcaatctttcctgagggtccagaggctgtctcattctttgcagaaattaaaagagtaacattcaattaacctcagcactgtgagtgtgaggactttcacaactgcacagataagtgatacctgggctccaaatcctcagggtagtgataccatttccctaaagacagaagatggttttgtccatgcaggcaaagaactattccttgggtgatcctctaatctatccagtctttttatcctgtatagctggtatggtttacccttagtaggatgaaacaaccacttcagtccgtgacagggtgaggtctgggatgcagatacagtgttttgtcaaattatctgtggtggcttggaagagccttacaaagacatgaagcttctgggtctctgctgcctgatccttgaagaaaaaacagattgacagatcagtgccccacctcccatccaccccaggatctcagggatcccctactcatccacaggggttggtttgagttagtggagggactcagtctgtctgtccctgttctgagactactacctctttgggcacccattgccattgttgcttgacccagtcctttcaccctcggttgtccagttctagaagggaggtcaagtactgtagaaacttgacatgtctgataacgtcatccaccctaatggaggaatcagatgacccccgtaccagtagaaggaaattaacaccctgatatttcttgatcctgtggaacccacagaaggcacccaggggaatcattccatccaattagagttaggaggcctgtctgggttatcatggtggcctaaactgcaacacccccaagaacatcactataaaaggaaaaaaatgattggaaaccctgagtttgggatttcacagtggcagctctatcaggaaactggccttgcccaacttcttcctcactcaactcagtgtttttcaacctgcacctccgtgccgtctttcccttgctctgcagtgcagtgtttaatgtccatttgctgtggtcagatggggtaccactctattagcaggttgtcctgatgtacactcttcagttgctgtgtgagtcagctgttctagcattaaatagatccattggcctttggataacaaggtgtatggaaagtccatcacgtcccatgagagtgtgtccattgacatcatttgggcagtaaagaactttccttggtcaaagcaaagtctcagtgggcatccaaaaacatggcataagttcatctcaagggtggtcatggtagtcccagcatccagctgagtgacatatttgtctcttacaggtggcaagctgttgccatagtccttttctccacagaggggatgctttaatagtccagtcactcggttactattttcctgatcagatagctagactgttggcagtggcccatgagttggtaaaaatatagcaagaggtggcagaaaggcctgcatgaccattaccactgcatgtagtttggaccattgggtggaatgaccatcatcagtctcaggaaagaaaatagtcatccactggctagatggtagccacccccagtctgcatgttttgcagagccctaagtgaaccatgccataccgatgtcggcatgtctctgaatcttggacttcgggtagccaaaagcagagccaaaccatcccccatgggtcatttagtcccttctagcaagctcgccatttgtttatggagccttcagatcccacgggttgctggctgggcctgattctgaatataccatttccatttgataatgcagctctattgagcctgtccagtttcactggttggatttttgcacccaagtgaaaaggagcagttcacccagcagcgccacacttggtgctcagccccaagctgtccagtccctgtcagtttccaatagcaagcaaggagttgccttgccaaagagggacatctggtggctgcttcagctggtttatgtgttcagtatctgagaggctggctcactcagtgacaattttctgttgccacatactccagtcagcatacatagagactgtggacacctgaacttccatcaggctaacaggctctaaaggtctaaaagaagtgtttggaccatgtcctgttgaacttcttccaaggctgctgttgcaaagggctctgttcaaggttggtggttttgtttgtgattttgattttgactaagtggactaaaagcccaccccagagaggtttatgctgtttccaatactcaaagaagcctaccagctgttgtcctttttattaatggttgctgctagtaccaacaatgtttaactatatccgcgatccttccttggtttcctgtccaagtggccttagcattcaacgtgaaatagtccattgttagtctctgttcccctaaagtctttttgccccgccaaactgagttgctccatggtgacaggggactatgtaacattttaatctgtttgtagcaagtcttgaaaaaaacaggtaatgtcttattcttcacttagtacacagtactgtttttgtcaaataacccacggagtcatgcgtagcttaggtggtaggcttcagtggatattcccttttgttaaggcttgaattcttagctgcaagggaatataccttttatgcagcagtgatgttctgtggtgcaaatatcaatgcctgtactgcactctgaggtgggaactacagtcaccagccccaacatggcccgcagggcaccatccacaagcagagaagcaccatggccactgcatttgtccctgaacctctcaatgtcattggttaaattttccccaatggagacctatgggctctggcacccaaaaacccagaaaagtatttccttattttctccttttatttttacatggtctagggccactggtttctggtgagcacccaaaggcattggctgtatccctaactgtgatatttagatcaagaaatttggaactgcaaatattgctttatcaaacaaatacaccaaacagtctgcataggccttccctgaactttttctgtatctcttatttagagagtgagtctccctttgtgtgaaagcccaaatagcatatgttggttccctctcagggatcttagggtccatttgagtacccgtttccctagctctctggctccaggaatgagcaatcatgtaagtgtctacgaaccagaggattttgtgcctcattctcatttctacactcctttctctctgccttaattcaggcagccagctcatctaaactcatggagagagtgatctataacccactgatcctccctcattccccataaagcacccagatgcatgtccaggccttgcaccttccagtctaatggtcctcccctggccaagtaatgggaggtatcattcttcccacttcaccaataagccatggttctgtcatactagaatcttctcaatggggcaattttgttaagcaggttaactgtgcagtgattaccaacttatttgagtccagggagataaaacacccttacacaactagttatgtgaagcaatttacaatttacagacaggcagcaagggatagcaaaatccaagaatttattgtaggtctgttcccccaaggctcaggaaagctgcctggggctaatggggtctagactgtgcttcatatacactgcagctgaggcactcttgattggacccaccctgggttttatatcttggagtcacatatcatgctgagctaaagtgttgaaggaaatcctgtttcaagagggtgtggcaggacaatactccctgtcaattggacagacaggtctgcatgacagtcacacagacaggcctgtgtagcagtccagttataccaacaaatttccacagcactgccttaacactgagcaaataattaaacctaggggaatcggttcccaggcatcaaagctagaagtaaaacataggtcagtgggaggcttgcacaggcttctccctaacctcaagcaagtcaaaataatggagacagccttacattcctagtgccaggacccgtcttgggtcaataaaatgagatgagtcaaggtaacagaggcagctgtttgaatagattcactggagagtctaaggcagctctctggaccaagctgtaaatgagataagatagaaataatcactccggtaccacagtcctcactgattagaatttaggagacaggtcttgaaggtactgggaccctcacagcttaatcggacttagcatttctttggcctctgacctagttgaaacaaaattagttgcctatagacttaggcaaatgttatattgcacataggcacataatgccaacctatataagcactaagaaaatggtaacactttcagcctggccaacatgctgaaaccccgcctctactaaaactacaaaaattagccaggtgtggtggtgggcgcctgtagccccagctactcaggagactgaggtaggagaatcgcttgaacctgggaggcagaggttgcagtgagctgagatcatgccactgcactccaacctgggcaacagagtgagactccatcagagaaggaaagagagagagagaaagaaagaaagaaagaaagaaagaaagaaagaaagaaagaaagaaagaaagaaagaaagaaaagaaaagaaaagaaagaaagaaaagaaagaaagaaagaaagaaagaaagaaagaaagaaagaaagaaagaaagaaagaaagacggaaggaaggaaggaaggaaggaaggaaggaaggaaggaaggaaggaaggaaggaaggaaggaagggagggaaggaagggaaggaaaattataacacttggagttggtctggtgatattatctctgaccttcttcctgtatccagttaaattcccttctttcttagtttgtctgcttctagttattgggccatgagaacatgcagccagaactcggcacaaggggattggaacagagcctgtgctgtggtggccaatactgccctatctcaggatgttacattcccaggatattctacagtgattcttgaaaactaagagtgagaaaagggaggagactgggttggtccaaggccaactggagactgtgctgcaaatactatagtgggatgacacctcattagtcctgtggcttgctgattttgctgagcatagtgccttcactgttcatctatgtgggagcctgtgtcagaatttccttcctttggaaagttgaataacattccattgcatatatatttatatgccacattttgtttatccacccttccctgcatgaacatttgagttgattccaccttttggctattatgaacaataattctctgaatgtgggtatataaatatttcttcaagttaatgttgtcagttatttggatatatgtccaacggtggaattgctgaattatatagtatttctatttttaatttattgaggaattgcaatgtagtttcttatactaggtgaccattttacatccccaaaacagtgtccacaagatttccaatttctccaaattctcatgaacagttttcattttctgttgagggaaaccatcctaagaggtataaggtggattttgttttcattgccctaagaattagtgatgtggagcatctttttctgtgtttattggctcttcatcagtcttcactggagatggttaatattgagtgtcaagttgattggattgaaagaggcaaagtattgttcctgggtgtgtctgtgaaggtgttgccaaaggagattaacatttgagtcagtggtctgggaaaggcagacccaccctcaatctgggtgggcaccatctaatcagctgccagtgcagctaggataaaagcagaaagcaggcagaggaatgtggaaggactaggctggctaagtcttctgaccttcatctttctcccatgctggatgcttcctgccctcaaacatcagactccaagttcttcagcttttggactcttggacttacgctggtggcttgccagggtattgtcagccttcagccacaaactaaaggctgcactgtcggcttccctacttttgaggttttgagactcaaactggtttccttcctcctcagcttgcagacagcctattgtgggacttcaccttgtgactgtgtgagtcaacattccttaataaactccctctcatttatacatctatcctattagccctttccctctagagaaccctaattcaggaatggtcaggaagcaattaatttccctttaccaatctattttagattgtctttgtgcaatgaattttttctgggttagtaaattaaaggagcctctaaaactagctacacattgtgaagtccacattagaggcagtggaataagtgtcccccagcatttaaaacccaaagatttgagggccctgaatctaagattttttctagctctcttgcttcataaatatgccctctgatttttaattctaccttagagaaggacaattgtggggaagatattaattgtgggcgaaatgaagaatgcccacatcccgtccatgtcctagtacctagaacctatgaattctaacttacgtagcaaaaaaaaaaaaaaaaaaaaaaaaaatcccaaaacttagtggatgcaacttacttaaggattaaggattttgagtttgggagaaactcctagatcatccagatgagatcaatataatcacgaaggtccttataattgggagggaggagggtcgcagttagataggagctgggacaatggagagggatactggagtgatggaaaaatgggtcatggagccaggaatgttgaggcatcttttttttttttttttttttttttttttttttgagacagagtctcactctgtcgcccaggctggagtgcagtggcgcaatctgggctcactgcaagctccgcctcccgggtttacaccattctcctgcctcagcctcccaagtagctgggactacaggtgcccaccacaacgcctggctaattttttatatttttagtagagatggggtttcaccgcgttagccaggatggtctcgatctcctgacctcatgatccgcccgcctcggcctcctaaagtgctggggttacaggcgtgagccactacacccggcctaggcatcttgaagattaaaaaggaaagaatcagattctctctcctagagcctctagaaggaatagagccctatgtctccttgatattagctcagttagacttctcatctccagaaccataagataataaatttgttagaagccagaaatattgtggcaatttaaccagtagcaattggaaactaatgcaaggggaaaaatgtcttttacgtctctgagtgtgtggtgtcctctgttctcccaaacattccatgttgttataatctggtgccagttttgacaagagatgtaaaccattttctatgagaacttgtaccaggattcttcttaggtagaaaatgtctagagtaaaccctttgattagctcttttccaatgtgtgttggagagttaagggatcaggtctcatagcacctgatagaaagcggagggtttgtttgtttgtgtgtttgttttcatgtttggcaggaaagttagaacacaacctgacaaggaaaaacttagagagattggaatctgagaaggaaagacttagagagactggaagggaaagagaagatgtgaacagggtcaggggaaagcaagatgtgttcctactccaaaatataaagcaaagtcatttacaagttttaaagacttcgagagggttatattttgaagagaaaaccacagaaggggctagtttaagattagggccagcctggcatgagacagaggcagcagggagctgtggattccacactgtttttatggtcccttcttcctatttataggctttgggctcaaccatgggatgaaagtggccacgtagaaggaacatactaaagccagacagacctgggcttcaatcccaagtctgaccatgtgactttgggcatttgctgaccatgtgacttttggcaaaccagtcatgagctctcatagctggttctctcatatgtgaaatggagcactttggaagtcatggggtattgtgagagtttaaccaaatgatgcaccctgaagagtgtatatgtgtgcccataaacatacacacacacacattatatgcacattttatatacccagttttctttaaatgcacccttgagtatcttagaaaaagaggctatggaagatattattaaccatatgtcattttcaaatcaaattctttaatagttattctacaactaacatgtgactcactataggcaatggggtttcatgtacattatttccacaataaaaacttccataaatccattcctgtgtagcactagaaacataaacaagatgacaaatgactataacacctttaaaccagatttcccctgagctccatctgtttagtgtacactattgggttccaaaggccgtggctacaggtctgagttctaaatccattcttcccacacccacagccttcccccaggtctcattctggcctcctgcatgctgggaatacagacccaccatcctgctactctcctgggaatccagcactaactacctggaagctttgcttagtaaacgctccaaatgcaacctctgacagagacctggctgaggcagccagcaacttcccataagaaaaccactgagaagggaggaaacttgcagaaccatgttggtgttgaggaaatgcacagtatcaccaggttttatcttttcaaacggttcctgtctctttcttgacaacaattcatgaccttggaaaagggaggaattaaggagaacaaagggatgtttcatgcttaggatataaaaggagaaatggagataatgaaagagcagaattgaggaactctttggcattgtttgggtttctcttgccatgggcatagcaggacgaaggtgccagggagaatatcacttatcatgtttcctgcccttcatgcctcagactcttacaaacacacacacttctgataatatgtttcttcttctgaagcacagtctgtggcccagccaggatctttctcttaagtgtcttttatagataagttggaataattttagaaacaagtcaaagaaataatagtaatggtttaagtaatgacaagaagtctgaaggttgaagcacttaaggttggtacaacagcttggtgacagctgaaaggccccagattgttactacatttttgctttgcacctgcattatcactggcttttcattcttgttgtaaatgccccatggtctcaagaggattgcggcagctctaagcatcatatcctctcttaactgttacaggaagaaatgcaaagcaaagctcttcactttctgtccttttctgaggtataaccattttcccatgatccctgcccactcctctgacattatcattttggagctgatcacatgtgcccttaatccctgctcccatcctgagctgggagaaactcaccaccctcaccatgtacggcaagacatagttggtgccctatacaccaaaggaagaaggggatgactgctgcatagctgccaagagctttgtcacattttaaatttcgctgtgcttctaagttaagttgtatagggaggagaacgtatgaacacttcgatctgatacagctggaagaagccaggctctgaggatgaaaatgaaatcaaatttctgatttctcatacgacatctttagctttaagaattgcgtaaatgtggcctgtgcatttaagaccaggacaggctttcagttatgggaataaatgaggagagatttggaatagggtcctcaacccaggactaaggtgaagcttgcacaacttgagactgctgggctctggccctgggctgtggaggaagtagctgctctcttgagccatggggctgaggacttgggaggaaccaaaggtcctgcccacagagctgcctggcagggtttcagggaaggaaactgctcatacttctatgggcgctgcaccaagcatagagtccactgccagtgtgaaagtctcagatacacgacccttagggctgggcctgagctcctggagctggctgctctcagctctgtcctcactgattctgcatggctggggccctgctggagtcaaagaaggaggaacagcaaatgtccccagagtctttactcagccaggctctgttctggttagaaagaaaaagaacacatgctaaataaacaaacttaaaattacgtgcataggtatatatttgcaatgtaacccttacaaattaaatatacatataatattttagatataagtaattaacaaacataaaattacatgcataggtatatatttgtaatgtaacccttacatattaaatatacatataatattttagatataaattatatttatacatttggatatactgtgcatctatattaggaataagtataatatgcacacttatatgttaatagatataactttaattgtcagtgtaagatatgatttttaaactttgataaattgagcacaaacatttaaaaccagcaatggttgcaccaccccatggccccttcatcactacacagcctgagggtcaggaagctcaggaccaaacctacatccattctgggctgagcagtacctccctgcccattgctaaggacactgactgtcctgacgggggtctggggaatcacagagcagcaggtgctggggagatgggcagtgggtctagaccccaactggagggacttttgtccccagagctcagggtgggcaggtcctcccctggtggcctttgtgagacagagtagcacacatggcccagtggctgtgtggtaacagggagaaaccattccagggaccattggcagcctcccctctgcctggattcagcccacatcaggtagggtttggggatacagccaacgcggtggggaggaaaaggctgggcttccagtctcagagcacagagcacagagggagtttcccacaactcagtgcactggcagctcctcccatgtaatctaggtcataaatgagacctcattttagccctaaaatatccctgttgattttcctagtatttctaagatcaggcttatttctggtgtttactgtggggtttgtctgccatctaatggctggttggtgacatagcatcttataggattttagatgctgagtcccagtcaatcttgacggtgagtcttttcatgggtaatgatgaagcagatcctattacatccatcagtaggccagatcctataaggaacacagaatgacacctctccttgataaaccagtcccaaagttgaggacaagggatatccagaaaagatgttgctcacaaaacgattaggaattaggttctgaaatccatgtgaaatgctgaaaatgtagttttggaagagagaaaaaggggtgtgagagaccctgccgggcataatggcaggggctggagaggaaatccaaggtcctcttttatggatctgtcagcccaggctcattcccgttattctggaaactcttccagagcagatctgaggaccacagtggttgcaccagctggagagcttctgaggactcccagttttccagactaacggctggtgagatttatgctctgagctataacacaatgagggaacacttgtcaacatttagagcggttttaagcaaaataattttctaagacaataaaaatgtctacatttatgctgtacaatagggtagccattagtcatatgtggctactgaacacttgaaatgtagctagtgtaactgagaaaacatgtttttaatttttaattctaattcacattatttgtggctgggcactgcaagtgtttaccaggtgagaggatacagtttcagacaataataatcagcaatgtcatcagggtacccgagctgctgaaagttaaggaagtgtctgccccaggaccaccgtgccaagcaggggtggaccatggccaatgtagacaaagcacatgggtggatctttgaaaccttccctggattcatctgcttctaggctggtgatggaaactctctctctgtcttggagatactgagggagaagctggaatctggggcccacaatgttgccactggaatctgaggtggaaacaaaacacaactcttccccagtgttaatgatgtctcactctacaggcctcccagagactcgtgttggctgatcaagcgggagatgaatgctgggcttgctgagcgatggtctgtatctcagcacgggacataagaaccctgtcacatggagctcccatagctgatgccaggacccaagggccagagccccaggtccagtgcttcctctgcctcaggtgatcccaccctaaaggcagcaaccaacccactgataagggcttgagtggcagggaggggctttgtggagcctgcagacttacaacagggatgcaaaactgaacttccagcttctgagccagggaacatttcatgttatgggtgtgacccaggtcaaggtgtttgatgaaagatattagtataaattttctccttaaaggaataaaatcacagaagacatcttattattatggtactggttggctttttcaatgcacaatggtttacctgaaatctcccagtccctgcccttctcgtgatgatcctatggtctttgctgttcctatggtcacttggctgcctcctcaccgttcagaagcatctccagtatgaccccgagaccttccctggtccgcacaaataaatggtctcggcctccagataccacatgccactgcctgaattttatacaatttatcagctattgaaatgattcttttcactttcactgtgtaggtattgttctctgaatggctcatttccctactgaatatcagtacttgggatcaaaaattgtcttatttactcaaatgctcctaaccctcacatgatggctttgaattgttcctgaaaactccgatattatgttaaaatccattaaatgcaaaaatatgtttattttttattgaagaagatatcatggcttcccctcagctaaagacaattaactacttttatagttgaaaaagatccactggacatgaaagaaacacatatataggagtaacaagcatcatcttgaaattagataaactcgattttcatgtaagatgtccagtaggcagaagaaaggccctcacagtgggaggggcttgatggagagggtcagggtgtctgtccctggaaggtgggggagggtgtgatgagtgacctcaggcaagcatccaatatcaggaccagacatgactatgagtaattcctttttccatgggttttgatgcaagaggaaagtcctgatggggaagctttgggaatagtcatagcatgagtggaatacgggttggaaacagcatgtttctaaacacatacaaacagctcacagacattcaaacaaaagtatctcacaaaatgttacctcttcctcaccttttcttgccatttgggtttaaccaatcatggcacacaatttgagtttctctacatgagggtctgcaacttgaaactaccctgtgaaagaactggtgactgtctgcctgataccataatgtagaaatacaatttcttgtagtagatcattgcactttggtgtaaaatatatgtgataaaaaatgtattgaaaaccgatataactttttgtgaccaaatacggtgaaagtcactcacaaaaatatcaccaaatctgatatgtctgttttctcaatgactacattgtatgccaaaaattatttttgaatgagtgacttaatgtgcacaggaaacaaagtaaaacaaataagctgagttgctcttggtattaaaaaattctaggagcaggatactggtcctataatcaagaatggtgaaattttttttttaaaaaaagaaaattcaaactgcagtttggattttggaggtggatgaaagaggacataaacaatacctctgatacacagaaaagaatatttactctcagggtggagggttgcccccctgtatttcatatgtcagggcaagatataacataaaatgcccattgagttttccacctcatctgagctcccagactattttctctgacatgttagtgccttggtacactcaacttttggtgaagttattcttattagggaatcgaggattcttaatttcaacttccttgggcctggaatcttgtcctgctccctagactggcaacaaagggctctggatccttctggttttttattccaggtaaatgttctttttggaaaagtctccttttcaaaatcccaagagaaatgtctatagttacattttccgtggaccagttttcagaaatcgcaacccaaatattcagcatttcctgaattctcagttgaatgccgcactggtgaaagtgaaccttaacgttaatctgacttaacaaacatcatgcttcagggggctgctttggaaatagaattaatttgtcacacccgtgaacccacaataactgaaacctcaatccatgggatcttctgtcactatagctctaggccatcacctgcttgtttcctaatctttacccttttaaactcttttgctataaatgagaaactgtagctctgaagagaaatctaaagtttttaccaacttgtaaaagatagtttatggaaagaaaagggagaggtgaccttcaacaactgtccatgtagtttgaaagtaaatatgggtaaagacgaaagtatgtcattatggtcttaatttgcattttcctgataattagtgatgtggagcatttttctatgtatttgttggcggtttgtatatcttcttttgagaattgtctgttcatattctttgcccactttttggtgggattatttgtttttttcttactgatttgtttgagttcctcatagattctggttattccttcaacagatgcacagtttgtgaatattttctcccactttgtgggttgtctgtttgctatgtagaagctttttagcttagttaggttccatttatttattttttgtttttgtggcatttccttttggggtcttagtcatgaattctttcactaagccaaggtctagaggagtttttccaatgttatcttctagaatttatatggtttcagttcttagatttaagcctttgattcatcttgagctgattttcgtataaggtgagatatgaagatccagttttattcttctacctgtggcttgccagtttttccagtaccaattattgaatagggtgtcctttccccactgtttgttattgtatgctttgttgaagatcagttggttataagcatttgggtttatttctgtgttctctattgtgttccattgatctatgtgcctatttttatactagaaccatgctgttttggtaaccatagccttgaaataccaccttactcatgcaagaatggccataattaaaatgtcaaaaaataatagatattggcatggatgtggtgaagagggaacacttttacacagctggtgggaatgtaaactaatacaaccactatgaaaaacagtatggagattccttaaagaactaaaagtagaaataccattcagttcagcaattccagtacttatttttcttatctacccaaagaaaaaaaaagttagtataggaaaaagaaacatgcacatgcatgtttagtccagcacatttctccatttcaaaaatatggaaccaccataagtgccaatcaagcaacgggtggataaagaaaatgtggtgtatatacaccacgaaatacttctcagccataaaacagaacagaacaaaataatgacctttgcagcaacatggatgaagctggaggctattattctaaatgaagtaactcaggaatggaaaacctatatgttttcatctgtaagtgggagctaagctatgaggatgcaaaggcgtaagaatgatataatggactttggggactggggaggaaggatagaaggggaggtgaaggctagaagacaacatattgggcacagtatgcactgctcaagtaacaggtccaccaaaatctcagacatcaccactaaagaacttatccatgtaaataaaaaccacctatacccccaaaaactattgaaataaatcatttttaaaaagatgaaagtatgcagcagtgactctagtttcctctctgctgggtgagccagacttcattgtattggttaactcattgcccccaaagcacctgcaacaatcagaagtattctagggtatcacccagtttctccgttcagccaggctgaactagtttttgttctgggttgtaacacagtgtgaggtaaactactactctgatgacagtaatacgctgcagcatcttcagcttccaggctattgatggtgagggtgaaatctgtcccagatccactgccactgaacctcgaggggacccctgagatggactgggaagcatacttgatgaggagctttggagactgatctggtttctgctggtaccagtgtaagctactaccaatgctctgactggcccggcaggtgatggtgactttctcctttggagtcacagactgaaagtctggagactgagtcagcacaatttcacccctggaggctgaaaatatacagcaaacatcagtacaacataaatatctgtgtatgaaaatcacctttaatcttgctagacatgaagaaagaatatgcattacatttttaaaattaggattttaaaatcaagccaaaaatcacctattgcagagtccccaatgaaagaaattacagattgaaagaatatctccgcctaggtttgtggaaatattctcacctggaacccagagcagcagaaacccaatgagttgtgatggcgacatcttcctgccttgacttgtcagttttgctcatgccacatcccagagaaagaacctcttttaagataccgagaggcagggcctcttcacatataggaggaacgatacatgcaaattatggggatgtcctgctggtttaaataaacagaaatcactgttgccaggagagcgccctcccggccccttccatgaggggtgtgaagcgccctctgctggcacctgcagacgagctccgctgaggctctggcagggcttgaccagaccccagggcacagctgcagagtgaaggcagagtccatcgccatctctgggagagtctgcagttatctggggtgaataacagctcacatcctcagtctcgtcccagggctatgttaactctcctgctctctgtcacaatgtaggctgaaaaagctttgtgaacgttccacaaagcatcaacactatattgatgacatcatggtaattagacgtgatgagctggacattgtaagaactctgaatttcttgtgaaaacacatgtgctctagagggtgggatgcacgccccaaaacatcaagggcttgtcacattagagaagatgtcaagtgtttataaaaggggtatgagtcatgctggcttatcccctccaaagtaaggaaaaataattgcaccttgtacttccaaccactagcaatgaagcacattactggttaagccatcctagagtgttgacaatgcattttgcacttgggtttactataccatcccatttatcagctaacttggaaggctgtcttttatgaataaactctgagaaagaaaatattctgtagtaagtttgagttttaatgcaaatgcctctgtcacttcagccatgagatccagcacattgcctggtgctagataatctatattagatgaggaaactctgtaaacctccatgcaagcaccaaaaaagagtcacagaaaaaaatctctacagttcttgagcaagatcctgaaatgcccccaaaataaacaaacaaacaacacacaaacaactcactactcaaaatgcagctctcaaaatatcacagggtccatgtaggcatgtccatgagtagttgactgtttgactaaataattaagtgactaagctgcccctcataaactgagaatgtcactctcaccaattttaagatcaggtgaagctcagcaccattcaatattgggatgcagatggtagtttagtgactgggttcaagcagattcagaaggcatgcttcatttccatcacagatgttccagttccttatatcacttttctctctcaacttaacacctctgcatcagctctctctatgatatcatgggttttcctgatcagctaatgccagagagataatacaaaaaaagaaaaagaaaaaaaagaaaataagcaaaaacaaagaaaatcaaagcaaaaatgagaacaagctgggcttcctcttgaatggcttggcatcatatgtttgtgtaagtaagtgtggactgtgtccacactatggcaacggtcatgcatggctgtcaaatactaccttgagttatcttacatctgagcagagcacatgttcatcaaattagtgtagatagagaagtgtctggagtcaagtatacatatagatttctgaatagctggctggctaaggtcctggaaaagaagatcatagcaatgggtttttcccaaatgtgtgaaactcataaacctattcatctgtgtgtgttctgaaaagtgtatacaaaatgtagccagttcttatctccctctgttttacttttcactgcaccccctttgatccctgttattcataacggcagcttttaagtcaccagaaatctgtgcagacattattttagcaattctatcattccatcacttccaggagtccactagtaactttcagctggtgtaccacttgccccagctagagccctcagtttgaactagcttgctctgttcatttcctgcagaattcatcacatttagctggaaacactgaaggatcttgcttgactctccacctcaactcaagtccactcccttcgactgcaagctgcaagctgacatcctcattaaaaccccagatctgcaattcatgctgacagagcggagatggaagggagaaatcccaggcaaaaggctacagacataatttccttccttactcaaaacatattctttcatgttatgaatagtatacagtattaaatgttttatactttgccaattttcagagcgctgaaaccgatttgatattttttagctttatgcttaatttgtctttctcatatatttttgctgagaggatttaacaatctctctgtaacacaataaagagagatgccttctaaaatgaattttaatgaatatgacagcaacactgaaaggatatagatatatgttaaaacataagtaattctgaagtaaagaatttgaactcaatacccacggtttgaagagaaatcgtgcacttaacaaatattaactcttggctggggacggtggctcatgactgtaatgccagcactttgggaggttgaggtgggcagatcacctgaggtcaggagtttgagaccagcctggccaacatggtgaaaccccatctctactaaaaatacaaaaaattagccaggcttggtgacgcacacctgtagtcccagctactcagggggctgagataggaaaatcgcctgaacctgggaggcggaggctgcagtgagccgagatcgcaccactgcactccagcctgggcaacagagtgagactctgtcaaagtaaagtaaaataaaataaataaaataaaataataaaataaaataaaataaaataaaataaaataaaataaaataaaaatatatatgtaactctaatcactagatttcacattttcagggaatgcactacaaatctgtaaaatatgccttatgcatattctagaattgaccaagtaagtgaatattctctacataatgggagccaggattgtctttaacagatgattgaaacacaaatatgaaaacatgatgaatcttgtgaaattgtttcataagaatccatgtcctttgttatgttttaattatttttatttatatattttaataacattgaaatgtttttagacttaaaatttgcataatataataagattgttctcatgtactcttccactagcttcttctgtaatgtcaacatcaagcgtaactatagggtaagtatcaataccaaaacattaacataaatgcaatgctattaattaagtaatttgaaatcccctcgtatttcactgattttttcagtaatctccttctttatgttccagaaaaaaaatccaaaatcccacactgcatttaattattgtgtccttaatatttcccaaattgtgacagttttttagttttgtctttcatgattttgaaacctttgaagtgtactggcaagttattttggagaatctcttaagttgcatttgtttgaagtcttctactgattagattcataccttttatttttagcaaaaaaacaaaaacaaaaaaaatggggtgcaacctcagtgcacagcaagaattacaaaatgtcaacatatcctattaatggtgatcaattaatatgaacaataaaaccctttttttaaaaaaaatgttttattatactttaagttctgggatacatgggcagaacgtgcaggtttgttacataggtgtacacatgccatggtggtttgctacacacatcaacttgtcatctacattaggtatttctcccaatgctactgttcccctagccccccaccccccaacaggccctggggtataacattctcctccctgtgtccatttgttctcactgatcaactcccacttatgaatgagaacacgcggtgtttggttctgcgttcttgtgttagtttgctgagaatgatggcttccagcttcatccatgtccctacaaaagacataaactcatcctttttatggctgcatagtattccatggtgtatatgtgccacattttctttatccagtctctcattgatgggcatttgggttggttccaagtcattgctattgtaaacagtgccgcaataaacatatgtgtgcatgcatctttatagtagaatgatttataatcctttggctatatacctagtaatgggattgctgggtcaaatggtatttccggttctagatccttgaggaatcgccacactgtcttccacaatggttggactaatttacactcccaccaacagtgtaaaagcattcctatttctccacatcctctccagcatctgtctgaggcctctgttctgttccatttgtctatatatctgttttggtaccagtaccatgctgttttggttactgtagccttgtaatatagtttgaagtcaggtagcgtgatgcctccagctttgttctttctgtctagattgtcttggctatgtgggctcttttttagttccatatgaaatttaaagtagttttttctaattctgtgaagaaagtcaatggtagcttgatgggggtggcattgaatctataaattaccttgtgcagtatggccattttcacgatattgattcttcttatccatgagcatggaatgtttttccatttgtttctgtcctctcttatttccttgagcagtggtttgtagttctccttgaagagatccttcacatcccttgtaagctgtattcctaagttttttattctctttgtagcaattgtgaatgggagttcatgcatgatttggctctctgtttgtctattattgatatataggaatgcttgtgatttttgcacattgatcttgtatcctgagactttgctgaagttgcttatcagcttaaggagatttggggctgagaccatggggttttctaagtatacaatcatgtaatctgcaaaaagagacaatttgacttcctctcttcctatttgaatatgctttatttccttctcttgcctgattgcccttcccagaacttccaatactatattgaataggagtggtgagagagggcatccttgtcttgtgccggtatttgacaagaatatgtccagttttgcccattcaatatgatcttggccgtgggtttgtcatgaatagctcttattattttgagatacattccatcaatacctagattattgagagtttttagcatgaagaggtattgaattttatcaaagaccctttctgcatctattgagataatcatgtggtttttgtcattggttctgtttgtgtgatggattacatttattgatttgcatatgttaagccagccttgcatcccagggatgaagccaacttgatcatgggtggataagctttttgatgtgctgctggattcggtttgccagtattttatagaggatttttgcatcaatgtttatcatgaatattggcctgaaattttcttttttgtgtgtgtctttgccaggttttgttatcagggtgatgctggcctcataaaacaagttagggagtattctttctttttctattgtgtggaatattttcagaaggaatggtaccagcttctttttctaccggtagaattcggctgtgaatccatctggccctggacttttttttggttggtaggctattaattactgcctcaatttcagactttgttgttggtctactcagggattcaaatttttcctggtttagacttgggagggtgtatgtgtcgaggaatttatccatttattctagattttctagtttatttgtttagaggtgtttatagtattctctgatggtagtttgtatttctgtgggatcagtggtgatacctcctttatcattttttatgtgtttatttcattcttctctcttttcttctttattagtctggctagtggtttatctattttgttgctcttttcaaaaaaaacagctcctggattcattgattttttttgaagagtttttcgtgtctctatctccttcagttctgctctgatcttagttatttcttgtcttctgctagcttttgaatttgtttgctcttgcttctccagttattttaattgtgatgtaagggtgtcgattttagatgtttcctgctttctcccgtgagcatttagtgctataaatttccctttaaacactgcttttgctgtgtcccaaagattctggtttctgaaaggaggtcttggacaaagctaattaagccagctgcttctatcactctttgtatttggttatttgctgactttctgagaaataacctattcctgtctgaaactatttttttttatgtttcttaggctttaaccctcttcacacttactgtacaatagagaatattgaacaaataaatgagttggcttttaaatggcaaatgttactatgatggccatttaccatttaaatgttaatagcctgaaaaaaaacccagaggaatgagatttattaaaatgtagtggtaccaacaaatgaacagcagttactgaatcaactgtttggaaaaacataattttctagcacttggaatactgcaagaatcaaatggataggaacagcttgccctgagctacttctgctgaggagactgagataccatttgtaccattttagtatgcacacagttcagacactctttgtggaaataagaggttctggtccctcagttaaagaacatgtggctacatatgcatgacagttatttctagaaatatgtacttctccaaatttttaagttattatctgaaaatttaatagaattttgtctttggatggtaatgaaacaaaaatgttagaagagaatggaaacttttgggtatatatagagaggatatcagagaagggtcaaccatactttactggatacagttaatctgactggggcttttggaggaaaagatttagagaagaaaagtgtttgaagaagtcatacgtgtttaaaaatataggcacaacttgaaaacccttgcaagaaagaatagatgacttcacaaaaaggtgaagtgacttttcaatttgtcaaatcacactcatacatatgctttttctttctcttttatgccctatacctctgaggtattagaaaggcctgagtttgaaataatttgtcccgtagaaatccagaaagtaagagaatgaacaacatctttagcacagaagcatgccaatcctgggaaaaacctgagatttggtttttgagttatggcagatgtagtagaaaaaatgagaaaaggttaaaaagacagaataaagattatgtaagaaaggacagcaatatgacattctaacctttcataggataaagttatgataatgaatgatgagaagaaatgcaatggacccatctgggtgggcatgattgaaagtctgagcaagttagtatagatcaagaacaaatcattagcattttaagaattgtgagtcagtcagtgaaaatcccatctcagaaactaatgtggctatagatgaaacatccttggattagaattaagattgtttctcctaactctcttctaaattagtctagtgatgataataatgattattacagtgctaaatgttatcataatagtaacaacaaaattaataccagcacatataatgattagatactattgtaaatgctttaccttgtataaattgtaaagagaccttttaggtagattctattattgccaaagtttcacataagcaaatttactaatggcacataatctataaggattaaagctctgtctccaacacaatggatttgatttcagggcttgccaagataacgtcttgacagttagataaatattgttgactctatttccagaatgaatgaagatccaattgaaacttagagcagcattagtaaaactgcttccttgatacctaagagaaaggaagaaaaagcaaacgattttaactgattaaaggaaaggagcagcagtatatgaaatgagattcagggggtgtaagcagaggttctgggaactattaaggagaagagaacctgactctggattgatataagcattgcacagaatcaagcggtgtgtagattagaggatcacccaaggagttgtcccctgcctatatggacagcatcattgtctgttacctgcatggacagcatgattgtctgtcttcagggaaatggcattggtaacctgaagggtcagaacctgggtgcttctcatctgtgcagttgtggtcacccctgcacctgcagcactgtgggtacttgagtgttgctctttgaggaagcttcagggccctcagaaaagatccctaagcagcaagtgaaaggtgtacttgggagataaagttccaataactcttcattccaaccatattctgtcatgcaccagggaaaacaactaggcatatttagggtagaaacaaaagaaatgggaccacacaacttaatttagttcctacaagtcttgtaccacacaccattcactgaatctagataattggtgagacaggaagacacagggatataagacaggaagacacatgatatatgtgatctaagatagaaattctacactcaggctaaactaacagccttttctgacatgaccacctgggtgaaagctgaccaatataatattcacacatccagtcatatagatagatgcatgttatcaaatctgatagcataaatataaatatttagtcatccatttataaagacacttagaggaaattaaagctaaatgatatgaattaagtgaaattcacctcacttatggaaaaagtgcacttacggaaacatgcacttatccactgctcaaaactcagcggataataaaactaagcagatattttcttgttaatagatgtttatgataacaatgatgtggctgatcaaggaagagcttagtggagtggttcttctgcctttagattgtgtttcatttgggatcaaggaagggcctagccaagacacaacatttgtatggaaggcagcaaaaaggaacacaattttcaaacaaaactgaccaggcaaatggtatcctaatgttctctaaaacagtgaacacaatttaatttattcttttactttgttaagtcctaaagtttctaaaaacgtttactgcatttaactatcaaagtatttgatccattgataaaaaataattgtttttcaacttttagaatattaaaaatatttttgaatgtaattttgcattaattagaaataaagcagcatatatttttaagtggttttaacataaatggtctcactgtgggggaaaaaaaaatctttagctaaagtaaatgtcttctaaaacttggcttcttgaaacacccgtacgttacctcttaactagttgaagtgcaggttatcatgcaacaaggtctaaagcacatctgctactttgcatttgtactgtgttcatagtgacgctgagaatgccactggaatctggacaaattttaagtagcaaagtgctcttatattaaggaaaaagtatgctacatgcacctataggtgttcttgtttgttttgtcaatttttttttcatttgtcaaaggattgctatgtatttcaagcaatgttgtcatttttttcttttactttacgacttaataaaattttcttgcaataataccaaactttctaataatacatgtaagaacatccaaatgtattctgaagccaccccatacctggaaaattctgagattttgggaaatacttatcccacttggctgtaattcctcatattcaccatgatttctaaaagcacctttcctgaaacccattaaaccctctatggtttcttgtagagttactcaaagagaagacctctcatcatatttgaaggtaagaagaaggcgattcaatattctttgacaccggtaggcaaacatgttcactgagataaggactggagaatcacctggtgaggtgctgcaacaactgatagcatcagcatcttcgcatacggacttcctagacaaagaagactatatggttagatagcccatgcctttagcggctgatgaactctggcttctggcagacctccagagactcccgtgtttctagtgtcagcttccctaactaccacactcccagttttgtatattcaactctaattccctgtattaaaacaatgccttctggcaatctgtagagtggtttctcttttaatctatgacccagatggatgcaataacacagattcttcaggtatcgtaaatgctatcctttattaaatcaggagagatagtgtcatgtctgtgctgctggggctaagcaggaagaaaaagaattagaatgcagatgagacttctgaccattcctacaaaaacctttaaatcttggctgcacctgagaaacactctcagcagatggaggcaccagtggaagcacctggggcagccatgagtcatacttctgcttccctgggggtttattttatgacctgtaacactctaggatggctgctgtaagtctatagacagtaataagttataacatcttcaggttgcaggctcctgatggtgagaatgtgtgaaatgtgtcccagacctactgccactgaaccgtgacgggaccccagattgcaaactggatgcagcatagatcaggagcttaggaggattctctagtttctactgatactagcttaaataattgcaaatgccctgactcgcccagcaagtgatggtgactctctctcctacagatgcagtcagggaggatggagactgagtcatctggaaatcacatctgactcctgggacataaaaacaaataatccacacaactatttgtaagatgatttccctgaaaggccaggctgtactgagcacattggctgagtaaattcctagtgttctccatccttacctgggagccggagcagcaggagcccctggagctgagtggggaccctcatgtccatgctgtgtcctgactgagactgactcctgcacagggtgtgaccagcctattaagaagtcttcagaacagggggttgtgctctgggaacatgcaaatcagcagggaatggagcaggctgggcacagctgcaggactggttcatggataagtatcttagatccagataaaacttaataaatattcatactcttatttttcacattttcagcttggcccaggacatcccagcctagctcagtagcaagaatgtgaatcgtttttctttttactcccataagaacagtaacataaaaccctgtgaatgctccagtcctggaggagaatgtgtgccgagaacaagtgtaaagtacaactggggtaagggagataagcaatgtgttaacaccaccaaatattctcccattaaatatatactagtaactgctaagccaaacaataccaagaatataccagtgctatgttgtcatgtatcagcctcagttgtgtgactggtaggctgaatacatctggttgacaaatgtatgcaaaggagagaggattgagatgagctaagtcacctttcccttcctccttcctcctgtctcctggctcagagggcacttgcatcttctgtaggttctgcccatgctaaggctgcgactgctgaagtgatcttatgtgtgatgcctgaggtgtagcttcatactaatcccctgagttcaccaacatcttcctgttacatagatttagagaatataccctgtctactcctcagtgaaggaactaatttgggcagctgggacaatccaagcaggaggcttttgtttggtgctgaaccattgtgggaggatattgtagagtgtggtggcagttgtaatagccaagatcctcagcctccaccctactgatcttaagcataaaatctgtccctgacctgcaaccactgcaaactcacggttatgtggtgcgtcacacagggccgtaagtcttcagtgactcaattgttagtgaagttcttgtccaaatgtatttcaggtcgtatcacaaatgcctatttaaccataggatatagaccagcttccaaaggttgaaactagtcctgtgatatatctggggatgactggtctactctctcctcccattggggagaacctgtgtgggaaggcagaaaactgattggaagtcctacagatcaggagctgtggagagtggcctggcttctgcaggaactaatacaaataggtgtatccattaccatgtaaaaggttctgactagacctgcaggagatggaggccggctctccattggtgacgggcagagagagtggagtctgggtcatcacaatattcccacaggatcctaaagtaatataaaaaagaagtacaatgttatgtaaatcatgagacattatcataatttctctacaattatttaatgctaaataattgtattgcggcgtgtgtgtgtgtgtgtgtgtgtgtgagtgtgtgtgtaattttgattcatgcaccaaaaaaattcaattaaaaaaaaaaacagacattttgaaggcccaagttgccctatggaagtcacttatgctaccctcctctttctatgtcagaatctgcaccagagcacaggtctttgctttttctggaatcttcctcactctttcacatataaaagtgccaccatacattttatcctggagcacaagacacgtgcatctaacatgtggacggaacacacatgggtgacagtggggcccccagagctcaccctcccaccccattctcctccctcatctcctctgtccttaccaggaacccaaagcattagcagccccaggagctgagcagggaacctcactgtgagaaggtgaactgaggagtcctgatcagttaaggcaaggttacagctgagcttttctcccagactcacaagggaagttcattcctaagggacaatatgcacatcccctggtggttgcagtggtgtggaaagagccaatgtacagtatgcttaattctaaaatgtatctttgtcttcagtattttaacatgccgcatcatggcctgaaacaagcaaacaaaataaaccagtagacaaaactagttactacctactacacatatatactaagtgtttctaagagttcaaaaaatattctcaattacttccagaattgaaaggaagaaaagtccaaatagtattatcagaaaatattattatgtggtgtacatgtttgagactcctgtgagctttgatttgctcaacagccaacatcatgcattgcaggcagctttccattctcctgatggttggtgagagtgagagtcactcagcaaagggagaaagaggtgccctgaaagtcatcagtggcagcaggtgaggtcaggatacactagggtcgcctcccagtgatgtgactaagtgtccctgcattcatgacagcagtagggaactttagtggctgttgcagggaggacatgacaaccacttcctggagagtctgtagggtgtcagcgcactaattggagagaaagggagaggctctaggaattgtcctggagggctctagcccctgtttacacagaagaggagccagtgtttgtgactgaaacctcatggcctcttcctggaaggctctccagccatctctaactgagcccacctggtatggacgtgtggcctgggtaccccagctgctcctgctgcattgagaggctgagcctccttgaggtttgtatgtggggccatcacacaacgcagcgtcccagtgagtgtcttgctaacagtcgtatgtgcagtatctccaggccccacagaagtgattgtgagtatgtaatcattaaaattttgactgcatgtgtgtctccacttttgaatatgtgcagaaaaatactttgaaggattgtcattctttgcctatgttacaaacgtcttgccataatccatttttttctggatttctctcctcaaaaattggattttaacttccctcaccacagaatgcattatcttggaatatacagtcatttctaatatggtttacttccttaacaaggaaaagagtatgttgtcctgctgattcaaatgcccctttactttgatcatatcatgtcatgattagtttagaaatacttttagggcattattttaagtgtcatctatgcaagctatatattttctatacaattactactagaaggtaggaatgaggttcattttcatgtaatgactacattgtgtgaaaacgatgcatgtacttatatattgaaaaccatttattcttttcatgacaattgaataccaaaattgtcatttctaaaacattatttagttgaaaaagttatctccactcccaggtacaataacattgtggttaaaagccctaaagcaactgctgcaaaaggtacaaaaaatacaaaatttatgaaattataacatcagagaacagtggacagaataaggcctaggtaatctaaaattccagggtgaggaaatcctctctaattgagctgatgcttacctgactttttgttctcctgccatatttgccaggttggcatttggacccaagttctgctttggcacaggcagagaaactcatctgtgaaaggagaatctggctgtgcctctttggttgcacaatgcagcctcaactcacagatagtgttctccatggaacattggctgtggtttgatgacatgtgcagtctttgggtgctggtctagaaagacagaaactccccatacagaggattcatggagtttttgttgttgataaattctgcgcagaccattcataatacatgtctgaatcatggatatattggtcatcattgccactgctccccaattgatgtagactctattgggacttcaggttagcatgccactgcatgatttgtgttctcaaacccaaccacatggcatctgctgggttgttttagtttgactgtgactaagtcacagaacctcaggtctatttgcacaggaacttcaataaacatttgatgattgcagaactaaaagatcattcttgatgaactacttttccttgaaacttgcagtggtgcaggctcaacccatggagccagggagtgatactttctcctctgtgattcttcataagaaagacatttgggctcctttctgagtttatatcaccaacccccaacagtcactgtcatccacaactgtacctaatgtaagtcaaagagcaggttattgggccatagttgacctccactatcttccattaattctcccattcttgaagtcggcccactgtcttcaaactcttacattttggggaaagaaatcgcacatcattctgtgttatttcagtgttctatgaggtaaattctataacctatgtcttctagtttaagtttctgtttatgaaactcaacttctgaaatttcaaaaactatccttttctgtcagcaagacacaattgaagcgaataaaataattttagcattcatattttctatctctcaccaatttacaaaagtccattctgaggctgaaatccaagattttcactaattgccctcatccagctcctcatgatgacagcttgtgcggaaggctctttccaccatcaatatgtggtgggaagataggtggtgaaagagaaaaataagaagttaggaaagttgaaaagttcaattttgggatattaccacatattatcctcctaaatatagactttaaattgctaaacctcaagatatattcaagtgttgcaacaaatctgggttacttgtctggttatttacctctttaagtcttatttcccaatgcaggcaaggcagggaagattggaataggattttcttaagctctccctcagggcagtctattacctgtgcaggcactgggatcacctctggtttcctatggcttatgccatgccaaggctgttgcagctgacagggctgtgaacaggttttgcctgacgtacaactgaggcacccatgggacagaaccctcagatgcaacctgttgccctgagttctccaacatgtttatctcatacagatagagattctgttcaactgctccccagagaaacaacacacttgagcagctgggccactccagcgggaggtttttgttcagggctgtaccactgtgtgaggaaattgtgtagcttgcgtgcagtaataaaccccgacatcctcagcttccaccctgctgattttcagtgtgaaatctgtccctgccccactgccactgaatctgtctgggaccccagagaaccggttagaaaccttataaattaggagtcttggaggctggcctggcctctgctgaagccaactcaagtaggtgtttccatcactgtgtacgaggctttgactagacctgaaggagatggaggccggctgtccaagggtgacaggcgaggagagtggagtctgggtcatcacaatatccccactggatcctgaaataatgagagagaagtgcaaggttatgtagaaactttaagcacaattttaaaataatttttcttctgttatttatttcaggctaaatcaatttttataatttgattcagaccctagtaatatataatttcaaaataaaaacatattttcaaagcacagcagagtgctttgagtgctagaagtttcctctaccattccctctttctctgttagagtcttcaccggagcactggtctttgttccttctggaatcttcctcattcttacagatctaaacctcacatgccttactcacgcagatataaaagttacaagccccatcctggagtacaagacgtacacatctaacatgaggacagaacacacatgggaggcaatggggcccccagagttcaccctcccaccccattctcctccctcatctctcttctgtcctcaccagggacccagagcattagcagccccagaagctgagcaaggagcctcattgtgagaaggtgacctgaggagtcctaattagtcaagtcaaggttggtgctgagcttttatctcagacttgcaagggaaggtcctccctgggggacaatatgcaaatcccctggtgggtgcagtggtgtagaaataacatgatatgtgcaggggtatgggggcctttcctatgaacaacatattttgtatgcttgagaaaaaactggcagaaataacaatctatgcagcctgattgggacaggatatatttctatgtttactgtgtttactgtcaatttttttacttcctagtattttcccagtgcttgttacacttctctttaatacggctgagtttctgtaaatatttggtgcttcttatttttttcttcatgtgtgttgaaagggtcttggtttgctgttaattttataaatcaaaataaattgtgccctgagtaaagtgcaaacatgttcactgctcaaccaaataaagtactcacattcactacccagatacaaatatgaatgatttgaaattctccacatgctgccttcattcacctttctagtcaatagcttctgcctctaacctaccaagggaactgcaactctgatatctatcacaaagattcagttttcgtgaacatcaacaacatatgagttgaggtaagtatatttatgaagctttcatttaatttcatggatttaaattactgttcattgtcatttactgtgattctgaattctgaaggatttcttcctgagtttcttataggacatatatgctagtcacggcttcttttcttttctttaaggatagttttgctgaatataaaatcattttaaactgatttttctagtacttcaaatagctttaacattaatggttaatccactattattaacgaagttacaatctacatttgaatttcactgagctttccactgatacatgtatttaccatttttacttttaatgttttaggataaaatttctggatcccatattgcattcagttttcatgctttcttaatttccttcaatctctgacagctttttagtctttgttttgaaataccttgaaacttttgatttatgctggctggttatttttcagaatgtcccttaagttctattgtttggtattttctattgattaaagtcagatttttcatttttggcaagaatattacagcagggatgtgtcttcagtacatcctatcaagagttacacagtatcaacatgtcatcactggtgttgataaatgaatattgctaaggaaccctttttgtaagaaagtcttggtcaaaggtaaccaaggcagctgcttttgtcactcctcctatatggttatgtgctgactttgttaggaattgtctagtcccatctgctatggtttagatgtttgtgatgttccaaacttaatgttggaatttaaagcctaagttgatattaaaaggtagaaccccttgggaagtgattaagtcatgggctctgcccttaataaatgggattaatggccttatatagaagatttcagagagctgcctggcccttccatctctgttgccatgtgcagatgcaagattcaatttgtctcctttgccttttctggctccaccagacagcttcaccgacactgaatctgttagcatcttgatcctagagttctgaactccagaactgtgagaaataaatatttattgtttataaatttcccagtctgtgagtttgttatagttgcatgaaagaactcagacactatctgattctctttttacttatttatttttttcagaattcagttctacttaaagcctgctctccaatagagaatactgattaaataaattatgctcactcttaaatgtcaaatatttccatcatggccattcaacactggaatgttgatgacgtgaaggaaggaagagaggactggtgtctattaaaacatagtggtacccaccagtggatggatgttcctgagtaatttggacaaatatatagtcctacgcatcacttagaatatttcagaaactaaatgaaaaagtttagaattgattgagctacttctaaagtgggaggttgagatgctattggtgccatactaggatgcacacagttgagacatgatttccaagaatctgaaatcctagggactaagttgaagaatatgtggctatatcaacatggtacttatttctcaaaatagatatttttctaagtttttaattcctgctgtgactaatcaatgggattttgtcttttgattgttgtgaaagtagataacttgttttgatttcagagacttatcagtggaagaatatgagtatcagatgtggctttaaacttggacttgggacttttgtgttaaaattacaataaggtaagactttgggcagatatggaaaaggaattattgtattttgaaatgtgaaaaggacatgagatttgagagagcccaggggtaaaaggatgttgtttgcatatttgttactgctcaaatatcatgtggaattgtaatccccagtattgcaagtcaggcctgatgggaggtgactggatcatggagatagatttctcatgaacagtttagcaccatcttcttggtgctgttctcatgatagcgagttctcatgagatctgcttatttaaaagcatatggcaactccttctctctcttctgctctttctctggccttgtgatgggcctactaccccttagccttccatcataactgtaagcttcctgaggccttcccagaagctgagcagatgccagcatcatgcttcctacaaagcctgcagaaatgtgagctgagtaaaactcttttctttataaatcaccagtctcagtatttctttgtagcactgcaagaatggcctaatagatttggtctcttttttttttttctttttttgagatggagtttcgctctgtcaccaggctggagtgcagtggtgcaatcttggctcactgcaacctctgcctcctgggttcaagtgattctcctgcctcagcctcctgagtagctggaactacaggcgtgtgccaccatacccagctaatttttctatttttagtagagacggggtttcaccatgttggccaggatggtctcaatctcttgacctcgtgatccacctgcctccacctcccaaagtactgggattgcagaaatgagccaccgagcccaatctctcctttttttttttttttttaataaagacactaattgaatcagatcagaatctcaaccttatggcctcatttgactgttagtttcttagagctacctccaaatatactcgcacatggagttagggcttcaactggtgaattttgaggggacacaaatattcagttcataaaagcttaccttattttcttgattcatcaaatacttgctctcttggcatattttgtggtcacccacggaggtgagatggatcttttctaattagtagatattatggtgaagctgttgacactccatgtacaagagaatttgggagaaattttctaactcacacaagggaatctgggggaaagcaggatatgcacaagctggtataagctggctcgagttacacagagggctgagtttttatagttggactggagatatgctatcttgcattgctgaggatctatgaggtttgactgtcctgcaggcagttgcacaaatatgtggtggaagggaaagtgggaggtggtgattgaaagctgtcactgatcaaacatcaaaaatggagtcagatgcttattacatagcacttattcgaaggtacatggtaccttagagtatcagctttttatattttgtccagctttttatatctgtttttagcagcttggcatgaaataaatttatctgctatttaacatagtgggagttttaggggaaaaatcataattttgtaaataacgtcaaagaaaacagtatttggggaaacactggatctacataattaagagatgtagcaaaattataatgattattagtaattatttagtgtttaatacatttgaaagttataaacattttataagtattcaattacttaattattataatagtcttatggtatagttacttctttattttcctttattagagataaaaaaacaaggtaaaagtgtttaagtcatttgccaaatttacacatatattaagtgtaagagacaaaattccaaccaatgatatgtgattacaatctgtgtgttctgttatcacagaaactaatatttcaaaatctctttcactgagctttctacctgatttcatcaattatgtatgagtaacttgaacaagataacactgctggatcattgcactgcctttgctcagtttcgtcacatgagagaggcaagatttgatgttgttgacagtaacagtaccctgcatcttcaggcttcaggctgctgattgtgggagcaaaatctacctcagactcgtggtcactcaaccatgcagagacactagggttctggatagtggcttgcttccctcaacctttgtccagaacttgaaaattgagaactcatgaacacaaataagggaacaatacacactggggtctacctgagggtggagggtggaagaaaggaaaggagcagaaaagataactattgggcactgggaataatacctgggtgacaaagtaatctgtacaaggaacccccatggcacaagttcagttatgtaacaaaacttcacatatatccctgaacctaaaacaaaagttaaaaaaataaaaataaataaaactgaggcggcacaatattctcattgacatctgaatttttttgaaaaaatcacataagcacaaatgtcagtgaggttaaacacatcccactctatgagcttatcatgttactcaacactgtgagtgctccatgagaaatcaaatgtcacagaccaaaaaaggtactaaagattcaacttacaatgagaagaaagcaaatttcaccatcatgtggcacctcctcataatccttttcctcatctgggatcaggcagcaggagacagaagagttgagctccttatgtccattatgtacatggctgaggcagacacctgccctgagccagggaacagcccactaataacggctttgatatgtagccaaatgctctatggaaagcacacaaagtcatcccaggctgtgatattttggagcttcttgttccagaacagattatttcacagctgtcacacacacacggatgctccttccccagtgtcttcagtctgtagagggactatgtggaacccctcgcttaataatactccaaatcaccacaacatttcctcagtcctcagctgcagctggtcttgttctgatgatgactaatgcaagtgaccacaagcatgttatatgaaccttataagaccatggtcatcataaataataatcactgatacagctattaattcaagtggcttgaatacagagtcattttcttggtatgaacctaacctgggaatgttccatacaaaatggatcaagattatgaggtcagttaccatactaacagaatttggggatttagagttgagggaagcaaagtaaaagaagaatgtggagaattttatacaaaagccataccgactataactgaaaataaaaaatccatgccttacagtgtaaattcaagaaaaaaaattcataataaagtgaaaacacaaagaattaatgaagaaagtttacattaaactgcctcaaaggataatgagagttttgatcaacatagaagacactgctaaaaactcattatttgttgtttgatttgatgaagttgcttgaagggataaaaagtacagtttgagtgaactcccattcacaattgctacaaagagaataaaatacctaggaatccagcttacaagagatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgtcatccccatcaagctaccattgactttcttcacagaattagaaaaaactactttaaagttcatatggaaccaaaaaagagcccgcattgccaagtcaatcctaagccaaaagaacaacgctggaggcatcacactacctgacttcaaactatactacaaggctacaataaccaaaacagcatggtactggtaccaaaacagagatacaaaccaatggaacagaacagagacctcagaaatagtgccacatatctacaaccatcagatctttgacaaacctgacaaaaacaaatggggaaaggattccctatttaataaatggtgctgggaaaactggctagccatatgtagaaagctgaaactggatccctttcttacaccttatacaaaaattaattcaagatggattaaagacttaaatgttagacctaaaaccatgaaaaccctagaagaaaacctaggcaataccattcaggacataggcatgggcaaggacttcatgtctaaaacaccaaaagcaatggcaacaaaagccaaaattgagaaatgggatctaattaaactaaggagcttctgcacagcaaaagaaactaccatcagagtgaacaggcaacatacagaatgggagaaaatttttgcaacctactcatctgacaaagggctaatatccagaatctacaatgaactcaaacaaatttaaaagaaaaaaacaaacaaccccatcaaaaagtgggcaaaggatatgaacagacacacctcaaaagaagacatttatgcagccaacagacacatgaaaaaatgctcatcatcactggccatcagagaaatgcaaatcaaaaccacaatgagacagcatctcacaccagttagaatgacaatcattaaaaagtcaggagacaacaggtgctggagaggatgtggagaaatagaaacacttttacactgttggtgggactgtaaactaattcaacaattgtggaaatcagtgtggtgattcctcagggatctagaactagaaataccatttgaccctgccatcccattactgggtatatacccaaaggaatataaatcatgctgctataaagacgcatacacacgtatgtttattgtggcactattcacaatagcaaagacttggaaccaacccaaatgtccaacaatgatagactggattaagaaaatgtggcacatatacaccatggaatactgtgcagccataaaaaaggatgagttcatgtcctttgtagggacatggatgaagctggaaactatcattctcagcaaactatcacaaggacaaaaaaccaaacactgcatgttctcactcataggtgggaattgaacaatgagaacacatggacacaagaaggggaacatcacacaccggggcctgttgtggggtgggaggaggggggagggatagcattaggagatatacctaatgctaaacggcaagttaatgagtgcagcacaccaacatggcacatgtatacatatgtaacaaacctgcacgttgtgcacatgtaccccaaatcttaaagtataataaaaaaaagaattacacacttaaaaaacaaaaaagaaagaaataatttatcctataggatttcccacatttagggtttgcctgactgtatcctcatgatttcactgagttttaaataataattacattatttccaaggcaaaaaaataaaaaagaaaagtacagtttgagggaaaaaaaatttaaaaaacacagacatttgaagcaggaagccctgaaaggaagctgtggctttatgctctgtggaattttgactgctgagtgccttcttcctgaaagggagtatctacagcattgtctgtcaagtatgtgcatcctagtcctgtctcatcattgttcacaagtcttgagtgggatagggggacaggtgctatttaggaactatgggcaaagaggctcaactgcacagagtctgatctagatgaggagatcttgaactttaacttaccaccatcatgggaaatacttgtagatgttgcagatgaaaattagtatatgttgcatacagtaaaaatgtagattgatttaaacaagcgtagagagttgccaactggatactccaagatagtcacaagatcttccatcttattagttcctctaatagtgtgatgttgataatttccctattggacatattagcatacttttccccctttggaatcttagtgaacctataattgtgatagaagtaacactatgtgtcttctgaggctatagtaagtcataagaggttataaaacatctgtctggtactcttcgaggaagtgtacaagaagccaagcaggagcatgtagagattcacagcctcagctgaggactcatcctatagcctgaattggccaccttttatatgactccatccccagctgctatctgactacatccatgtaagaaatcccaagcagaaatcttggtcagcccaggaaacacctaacaactacaaagataatagtataatgatgtcaattgtaatgtgtcattaagttttgggtgatttgttctgaatcagtagtaactagatgccaactcataaatatagaaagaatttggaagtagaaagtcatctatggttactaaatgaatttgggtaacgtatacattggagttcttatattactttggcaatttttctttaacaatatgcccaaataaaaagtcacataaaatatgttcaacaaaaccaaacagaaatgtacaaaatgcagttggataaaaataaagaaaactccaataaatggaaggttgcaccatgctcatgaattgggagacttaatagtgtatattctccctaaatttgttgaaaacattcacaataaaaaatctcagagaattattgttgcaattgaaaagacattacttaaatatatatgaacattcaaaatgcaaaaagtaaccaagacagtcttgctaagataaaaaatgttggaggactaatactacacaataccaaagcctgtaagttacaggaattaaaatatatggtatcagtgaagtgtcaaacaaattagccagttcaatcagtttgagaatccagaaactgctccacccatgcgtagtcatttgatttacaataaaagtgctacttcaaagtagtagaagtaaaataaattaatcatactggatcaattcagtatctgtattatatgaaaatgaatcttaattctattccatatacaaatattaatcatcaataaattgtaaatataaatatgaaaggcccaagagtaaatcctctacaaaagggtatagaagcatatttcatgaccctagagataaaaaaaaattcttagagaaaataaacaaaatatctagcataaagaaagaaattaataaattagacttcactagtatgacatcctttttataatgtttaaaagaaataaacagctttttaaaggaatacatgtagaagaaataaactacattgataaagaatattgaattgaaaattttgattaacttgatggtggtgggaaataatatgtttaagagattgtggagaacctcaaactggatatgttgatatcttaagtggttgttttgcaggatagtaacatgaatttattatattactaatattaatgaatgaattagtgagtgctaaaaatatgaataaataaataagaaccataatggactaataataaaagtgcattatggaccaacattataattgtgttattaaccatcattgattattattccttgcaatcagttaataaagttgaggcccattaaaaaagataatagaaaaagaaaaatgaaagggaggaaggaggaattgaaaggaggaaaagaagatgttgtaaaaaaaataaagagaaaagttaagtaaaaaaaaaaacactcttgtggactccagaacatttctacattatgttttgcataatcaataaaataaagaaaaatatataacctaggatgaaaaatagcacaaaatatgtaattatcgaaaatgtaagcatagttccttaaactctgctgcaatataagaaaaataaaacaaactgcatcattaaaaacaaaacccaatattcaagacaatatagcagaattggcactgcaattgatcaaaacagtgatatggaaggcaaactagagtagcacttttgtttttcaaaggagagaatcatgacattagataataaagagagagctcagacagaaaaacagagtagaaagttaaacctgagaattaaacattttcctgaggaagaaatgagtccttagaaaagaaccagtaagaagaaatgtaatctgaaataaaatttccatgtctgttaactactaatgagtgtaaattcaatggagtcacacaattgtattcaaacatttataaaatgagaaaacacatatatttcataataaaatacaaattcaaagaatgtaagggttatttttttcaaagataaatgtcaggcttgcttcagagtcctggcctgcaaaatgaactcccagtaatcaatgtaattatatttgaaaatgtgcaaagtttttataaaagaaattatactgcatgcattttctattgaactagggaaataaaatatgaagaaaatttttaatttgaaacaagtaaattatgatatgcataaggatttatgaaactagaaacccttgaaaaatgtattacagctgataaagagatgaagtaaagtcggttgctcaagaagaggaagctgtggtttgtgattgtaaaagaatgttggtgaggataaaaatcaacaaaacctataagttaatctacctaagttaaaaatgtgttgataaatgcaaagtcattccataggaaaaattcctcaaatataaggcatataatgcaacgcaatttaattgtaataatctgactataacaacgacaatattactcatgcaaaattaggaatcataattgaagggcaataacaagttttaccatcatactggtttaatagatgataaaatttaataaccagtattttccttgacttcaaaatttaaaattatagatttatataggcataacaaaaagcaaatatgacatatacgtttatattttgttctttcagtttattcccattctatcttgtttaggattcactcacggtggtcatttattaattttttttaaataaaacatctaacctttcgagatcattctactctatataaggaattacaacaactgacacaaaaagttaattagtgagagaaagagatgtcagtgctcagtccttttatgtcaggcactagtccagaacacaagatcctaaggacagacacactacctaaagaacaaggcattctgcttaaatgttacctccttcctaaaggaaattttcacttcactttcctcagatccccgtctttcattccgattagcactccttagtttgtgtcttgaaccagttcttccttgtctgaaggaacttttccacttcctgagtccattcccaactctaaacaccattgcgagtgagtgccatccaccaggtagtaaaaacatgtaaccaggtttgggaagactaggaaaaatttaaaaactatttaatgggcatctctaagctaccttggatttattttcttacatctggatatattctagttcttctaaatacctcctcactcagaggtttttcttctcattgcataggttggcaataaaatagaatctttgcactgctggtggaaatgaaaaatggtgcagcaggtttggaaaacagtctgcaattcaagtggttaaacatagagttaccacatgatccaggaagctcttaagtgtggacccaagaaaaaggaaaacatatatctacacaaaaacttgtacttcaatgttcttagcaagttactggcacatctttagaattatttaggaacagctttgtcctaaaaaggggtcaccagaattctaagtgatgctcttcaactagctggatgatcttgaataattcctatcaacaaatctatctgggttttagtcatctcatctttactgaaggatatagcaagtataattttgtgtatgtttttatttcactttttatagtgtaaaattaccagtgtcttcagtgaataaataaaagtgaaaaacacattgaagcaaattgttctgattctacaaatattgacttaattggattcgtacatttagggtaaataggaaccatcattaaaatgcaatacattttgagtagcttagaattttgatgctttccaggacaaaaaaataaaagagattatagtgactcatgtgttcctgatgacactaagagtgtggtaaccttgtaaaccctgggcttccttacatttggtgccctggtttcacagatggaatgtgaaaatgaatacagattataattaaatataatttgattagataaggaaagaagttaggatgcattgattggtgcaaataacattatgcttcataacttttttaaaataaacttttgataagataaaacttacccatacatgtatattcacaaatctcaacatgtgtatatgcactcacaaattataatgcaggttttaataaatttttcagagattgaacacactgtataacaaccgtaccaaagcagaacactcccggtctcctagaagcaccttctgtctcctcccaaacattagccccactcttctccaatgcaaatttaaatctcactttcagtaacattgatttagtgatggcggtttttgaactatataaaaaggaatcatggatagtgagctttttatttctaacgtcttttgcgcattattatgctagtaagatacacccacattcatggatgtagtagcagcttttatattttcattcatccatagtatttaattgtatgcacctacctcattttatttattcaaattactcttgatttgtatttagaatattcccagtttggggctatcactaataatgctatgagtgttattttatttatttatttatttatttatttatttatttatttatttttgagatgtagtctcaccctgtcacccaggctggagtgcagtggcatgatctcggctcactgcaaccttcacctcccgggttcaagcgattcttctgcctcagcctccctagtagctgggactataggcgtccgccaccacgcccagctaatttttgtatttttagtagagacagggtttcaccatattggccaggctggtctcaaactcctgaccttgtgatctgcctgcctcagcctcccaaagtgctgggattacaggcttgagccactgcgcccggccaagtgttattgcacatttctttctgtgcacatctgtacacatttctgagtggaagggctggattaaaagggattatatattcagtgtcagttctccaacttgtggtaccactttatattcccaaacataatgtgtggcccttctagttccccctttccgtcactgtatttggcattgtccctttgagtcatcctatcgaagttttagtggtagacagttgtgattttcatttgtaggactgggatgattattgatgttggacagctttttattgttttcactctgttgtgcagtgtcacctttgtccctaaaaagtgtcactatatgtgttagtcattctcagaataccctcttctgttgcattaggcaatttgtttgaactcacatcagcagcacggttcgagtatccaagtagtgtaagtcctcattcttgggcttcttcgggtttattgtggttattcaaactccttaacaatgtaatatgatatttagaatcagcttttacatttccatttacaaacagtttgaattttgatttcgattatctttaatatatcaatctgtgaagaatgaacatctttacaatactgggactttcaacctttgaaagtactatggccttccattggcttagattttctttgatttctttgaattatattctggagctgtcagtatattttgttagttttttctaatgcctcttggtttgatgctactataaatgatgtgtttcataattttaatttttagcagttgttacatttatataaaaataaatatatttttatattgatctttaatctatttactatgtatctcattgattctaataatttctgtgtagacaatttgaaatttctcccccacacagtcctttcatcagtgaattgttatacctttaattctgcctttctaattcttcttctttatcattgtcgttgctactttatcgcactggccaggacctttagaggcgtccactcatgtgagtctgatccaatggccttgaccatgaaattgtgcctgaacctggctgtgcatttgggtctgagaaaaaaatccatcagtgaaactataaatattataaggaattacttttgagaacctcagaatttccaatcaaagcagagatgctaaaactgagcagcaccacatcagatgactaaaaaggaagcaggtggtataatcaaataaacaccttaggtctcctggaggtttttgttgcatgttgaatcagtatgggacaccaactactatgctgataacagtgatgaagtgcaaatcttcaggctccagcctgccgatggtgagagtaagccctgtcctgacccactatcacaaatcagggctgtaccatagatgaggagcctgggagcccgctcaggtttcttctggtaccaggcttagtagctgctaacactgactggccctgcaagtcagggtggcttttttctccagagacaaagacagggaagctggagactgtgtcatcactgtttctacagtgaaatctgagattagaaataaaatgccttacagtctttaggatggctattataaaaaagacaagagataaatattgatgagggtgtgaagaaaataaaacacttgtacattgttggtgggaatgatgattggtgcacccattatggaaaacagtatggaggttcctaaagaaattcaaaacctaaccaccttataacccaacagtgaccctattttggatacatacacagaagagatgaaatcaccaccttcttttaaagatacctacactcccgtgtttattgcagcattattcacaagaaatgagaaaaacctgagcatccgtggacaaataaatgaataaagaaaatgtggtatacataaatgcacacacacacacacacacacaatggaatataattcagccttaaacaagaagattctttattattattattattatttttactttagagaagtctcactcttgtcgcccaggctggagtgcaatgatgctatctcagctcactgcaacctcctcctcccaggttgaagcgattctcctgcctcagcttcctgagtagttgggattacaggcccatgccaacacgcccagctaattttcttttgtattttttgtatttttagtagagacagggttttgccatgttggccaggctggtattcaactcctgatgtcaggtgatgcacccgcctagtgctgggattacgggcatgagccaccacacccagccgaaaaataagattcttctatttgccgtaatatggatggacctagaggacagtattctaagtgaaaaaagcgagacacagaaataaaaatattgcctgattttacttacatgtaaacctaaaaataaattaaataagtaaaaagataaattatgcagaaatagagaatgaaacagtcgttattaagggccgggggtggaacgggaagaaatgggaagatgtaggtccaaagatgcaaggtagtagatatttatgaataacgagtatagagatctactgtagaaaatgagggctatagttaataaaactgtactgtattagagatttttgttaaataagtagattccagctgccagctgctcttgtcgcagacgaaaaagtaactatgtgagatgataaatgttcattctcttcactatagtaagcattttactatctatatgtatgccacaacatcatattgcaaacctaaaatatacagaataaaatttattttttgaaaaaacagtttaaacagaaaaacaaataatcacacatgtaatctagattatacccattgtctttccaatagagtcaagaccattgatctacattgagctttaattattgtgcttgctgagcagagatgccaggttgaaggacccaacaaagttgagagagttttcactgacacacagaaccccccacaaccccccgcatattcccctcacctgggacccagagtaacataaagaaatgataaatacatgagctgatgcacatcctaaatatcctgatttgatcatttttcaacatatgtacatatcaagacatcaaagtgtactccataaatatgtacaattacaatgtgccaataaaaacaaataaaatgcaaagttacctattagtgacattagaaagtaatggaagaaatgaggactaggcgatctaaaattctagagtaaaaaaacaactaattctagttgagttggtgttcatctgacattttgtttttctgccttttttttttaccaaatgtgcgttcggatagaaattttgatttggcacagacagagaaacccagcaagaagagagaacataactgagctttgaaggttgcacagggcaatttctgtgcaaccatagccagatttttcatgtggcatttgctgagttctgagtcaggagacaggctgtgggagtttgggtaggaaggcagaaatctccaacactcaggatgttttttcctccagtgctgtgcaaatcatcctttgtatatgtctcaaccatggacattgatcactatccctttctgctgggccttttggttaacacgtcactgcatgttcatctccacaaacctgaccacatcatctctgctataggggcagaatgagttctagaagatctcttcatgctgagttgaatgggattgagtctttttgcacgggaacttcactaaacctttgatgattacaaacctaaacaccttttctcaccattttcccatgaaacttgcagtggcacaggctcaactcaggaagccaggcagtggtctcttcaactctgtgactcttcacaagaaatacatcgggacttgattttaggtttatgtcatcaacttgcaacacccactggcatctgaagttcaccaaatgtaagttaaaatgcaggaggattgtctaatacggtagacacagtagctcatatctactgtgttccttgtgtgttcccattcctgaagtaccctcgaagtctaaaactgttatcattctctattcttctagcaatatatagggtgaattctatgccctgtatattccagtgtatgcttttatttttaaaacccaacttttggaatttcaagaattccttttatgatctatcagtaagaagtaatcaaggcaaatcaaagagttttagcatttggatcttgtatctgacattaatttacaaaagtctaggcactcaaaaaccaagatttttgctaattgcccccaaccagctacccgtataaatggggagccacattttacaactagtgtaaaatgttgtctacagtatctttattacataggaagataaggaataagtaaggaaaatagaaagcttggaaggtggaaaataccaatttctaaatatgaccaaataattatcctattaaaatatataaaaatggatgaaatacatacaaatgaggaggcactcagcatgtgttgccaacatttgtatcaattgcctggcacttatgctgattaactacaattgagaaatgtaagaaaggaggattcgaatgagcttttattcagttgcatcatgaatcagcatcagctccatgggaccttccccattctcctactgcttttgccatgtcaaggcttttgcagctacacaaatgagtagttcctgagatgtaaccaaggaattcatgagaccaatctactcctctgagttgtccaacattttcctcatgcacagactcagagaacttgctgtgctgctccccagacaaacatcacatgtgagcagctgggccacttcaagcagagaggtttgtgctcagggctgtagcactgtgggaggatcttgtgcatcttgcatgcagtaataaactccaaaatcctcagcctccacccggctgattttcagtgtgaaatctgtccctgacccgctgccactgaacctatctggcactccagagaaccggttggaaacttcatagatcaggagcgtggagactggcctggctttctgcagaaaccaatacaaataggtgtatccatcactatgcaggaggctctgactagacctgcaggacatggaggcctgctctccaggggtgatagacaaggagagtggagtctgggtcatcacaatctctgcactggatcctaaaatagatagaaagaagtggaaggatatgtacaaatatcatgtgtcatttatcataaattttcattttttatttcaggctatataattttttgttgtttgtatttatacactaaacatattccaaatttgcaagctgcaaaggggattctagaagtcacctacaccacctccctttctctgtgtgacgatattcaccagagcacacaggtccttgcttctttttgaatcgtcctcactctcacagatttaaacctcacattccccatcctggagaacaagacctgtacatctaacacatgggcagggcagaacacacatggaaggcagtggggtccccaggcttaccttcccaccccattctcctccctcatctccttctgtccttaccagggacccagagcattagcagccccaagagctgagcagggagcctcatagtgagaaggtgaactgaggagtcctgatcagtcaaggtaagggttagagctgagcttttatctcagacccacaagggaaggtcctccctagaggacaatatgcaaatcccccggtgggtgcagtgatgctaagcgcaacaacaggaggatgagggcttctcttgtgggcaaggggacataaaatatcctgcgtgtttcaaggaaaactaaccaagataaaatctgtgttgcttcagttggagaagagacatattataatatttccttttctttccacctgtttttcaacagttctttagcacttttccaggcacattttgcacttgtctttaataaagttgagtttccataaatattggctgattcttttttcttgcctccaattttctttaaaagaatctaggtttggcttttctatttttttttcattgaaataaaccacatataaagggcagaaatcctaaatgtggaatgaataaagttttatgtatattcactatccagctgaaactatagaatatttcaaaatttctggatgattctctcgtacaccttcccattcaataactgcctccccatcccaaccaaagtaactgtctttctgacatctaccacaatagtttgtttgtacttggtagtgaatatcatagaaattgaagtaaacatttttttatcattgtgtctatttttttcccagttctttactattttgaggcctttatttctgtttgtggattcaaattactgtcctctataatttcatgtgattctgagcaatgttttcttaaattgatttcagataatttattgaatatctacaagtaatattttcttttcatttgtgtttatcaaggtaaggactaagctctgattttttttttccttgtctcagttcctatctaaggagtctggggagtcatgccctacaaactataaattctcatcagatgggttttatttaaccctacatatccttggacttactttccaacctgactgtggtggaacattatgcaacaaggcagaaaattaaaatattttaccccaaaacatgtttctttgccctatcttgaaatggccttgcaaagctgtcctttgtggggaaaaatttgcatctgtaaagaatctctattaacatagccagatctttttcttccaggctctcccaatcttaaagaagagtctagcacattttaaagatctgaataggaaatatttgtaatctattttctctaagggcagccactgtatgacttcaaaagaaccttggtcttccgcagtcttttatcttaacctgaacatttattttctattgatcccaggtctttagacaaactcaaccaattgtcaacaaggaaatgctagttagagcctggaacctcccccgcttcaccaccccccatcctcacccctgctttgagttgtcccgcctttctggaccaaaccaatgtatttcttaaatgtgtttgattgacgtctcatgcctctctaaaatgtataaaaccaagctgcgccccaaccaccttgggtacatgttctcaggacctcctgagggttgtgttgggggccacagtcactcatttggctcagaataaatctcttcaaatattttagagagtttgactctttatcgacaaagaaatatgtttagtttgctttattcttaaagtatacttttgctgcatatagaactttgggttgatttttttctttcagcatttgagtatgccattccaccgtcttctagtctccattagaaataatggacccttattcagtgtctacattattgtatctttgtacatagtggtttttttctcttgaagattttccctttgtaactgtatttcagcattttaattacaatgtgtgtagttatgaatcttttttgcttcccctggatgtgtttcatcacatttcttggatctatatagtaatgtatttcaatacatttgaaaagatgttcccattatttcttcacatactttttcagctcctttctctctcccttctcctttgtgactcccatccacatttgttggtgttcttcacactgacctatacatctctgaggtcttgcttggctgcttacatctttattctttggaacagattatttctattggttgatcttcaagttcactgattcttctgacactgtcaactattgtggtgcctatctaaattttcaattgagttattctacttttcagttttaaaattctcttttggtatttttttgtcttcataacttccactgttctactgaaagtcgctattttgaaaccaccattgcaaaaattttaatagtaagaaaattatggcagtaaaagagatctgatctaacccacctccccatcttgcattttccttaattattcctgggcttttgggcagagctaactttggaagccatttaggttatagtttaaatgatgatatgggttacccaaaactcagctacctttgtaaagatcatgaaaggccatcaaatagtgggaaaaaaggagcctgattctgctaaggtgtggactggtcaccagatactccttcagataacaccactattgtagattggccttttaagatatattttcaagtattgttgcttatctgacagcaatggctccacctggacctgctaacccgcatcctgtggccccactcaggagagattcagctccagaggacagctctgacattttatgacttcatttctgacccaaccaatcagcagcaagcacccattacctggccaccccttcctccaaactgcctttgaaaaacccctaactacaggccttcagggagattgatttgagtactaactctgtctcccatgtggtgtggccagccttatgtctactaaaactctttattgcaaatgaaactgactttgcaaaattatgactgagacagtgaaagaggtctaaattaactgactccatcttgcttctaacctccaagttgtccttgttcattcctgggcataggctgaactaactttgagaggaatttagtttagagtttaaaacaaagacaataacagccttttcccaaagcagatgttcttcttgcctggggactagataggctttgtaggactaacattagccacaagattggaaattatggtttatgagtcatgcagctggaggctacaaggttctgaccccctcaaactgctcctaagatcagtgcttgagatattttgatcttgcacttgacggatcagctggcaccacccagatcaataaactgctaatctgatcttatggtctcccacccaggaactgactcagtgcaagaagacagctttgaatccctgtgatttcatctctgaccaatcagcactcctggctcactggctcacccaccacccaccaagttgtccttaaaaattctgctccctaaatgctcagcaagactgatttgattaataataaaactctggtctcccgcatagccagccctgcctgaattactctttctctgttgcaattcccctgtcttgagaaatcagctctgtctaggcagcaggcaaggtgaacacgttgggcagttacacaatgtcgtggtcttcatttgtgcagtggttaggaaaaatccctcagctaggtacaatgtgtttaatcatttttttcatattttccattttaagtatttgatcatagagtactgatcgaaagaaataaattttttaaacatctttaaaataactctattgaattcaacatctcatttgatcttttacaactgcaggaggtgagcagcaggtaagcaagcaaagcttcctctgtctttagagcctctccccattgcttgcattaccacctgagctccaccatctgtcagatcagcagcagcattagattttcactgcagtgcaaacctcattttgaaatgtacatgtgagggatccaggttgtgtgctccttatgagaaactaatgcctgatgatctgtcactgtctcccatcacccccagatggcaccatctagttgcgggaaaacaagcccagggcttccactgattctacattatgatgagttgtgcaattatttcattatatattacaatgtaataataattgaaataaagtgcacaataaatataatgtgcttggatagtcctgaaaccatcccccactctgagacccatggaaaaattgtcttccatgaaaccagtccctggtgccaaaaaggttggggaccactgctatagataatagaaaccgggattgtcatttcaagaaacagaaatcacaaataagaaaatgaggaaaaatagaatgatacttgtggaattgctccttaggagcttatgttcttttcttacttatattttcatttgtatattttaattagttttgaaataaatttagatttatgcaaagtttcaaaagtagtagattgtttcaatatacttctcctccaccttctcttaatattaaacatcttaaataaccaaagtgggatgatataaaatgaaaaattaatattgatacaatagtatttactccatatttggatcccaataaatttttcactaaagattctttcaagttccagtatcaaatccaggatgacatattgcacttaatattcttgtctccttaatctcctccaatctgtgatcattgtttattctttctttgtctttcatgacctcaatgcttgcaaaatgtactatcaatgatttttaagattgcccttctaattttctcaactaattcagattatatgtttttgacaagaatatcacaaaagagatggtcctcgtcagccagtgcatcatcttgagttgcataatgtcaacatgtcttgttacctgtgatgatgaaggaccgtgatcaataaaatcctttttgtaaaatgttttggacaaagggaacacacgcaactgctttcactgctcttcccatttggtcatgtcctcacattattagaaataatttatttttctctgagcctgccattacttatttttttttcagaatttagttatttttgaagtcttctaaccaattaagaatattgaaaaaataatgttcattcttaaacagtaaattttcagtgatgccatttaccaatggaatgttgttagcttgaataatggaacaggggaataggattattaaaacatggaagtattacaccaacagacagctgttactaagccatgtaattggataaatgaactgaattttctaccactaggaatgttatagaaatcaaatggaaagatactgcaagcactgagctgctcctaactggagagattgaaatacaattgctgccatattatataattcacacagttgagacacaatattggagaagatgaaagtctagggcctcagtttaaaatatatagcatttgttatgaagaatatatatttttccaagtttttgcatttgtcatctgatgaatcagtgggattatgactgagtgttgctaggggtacggaaagaggagctattagagaagggctaccagactttactggatataattagcctaacttggacttgtggagaagaagacttagaagaaaagcatttggaaaagccacacatgttttaaaaatcaaatacttgcatcttgaaaaactatttccagagaaaagcaatgacttagcaaaaaacttaatgacagtttaggtgaccaattcagtctcatacacgtgcagctgctttgctctttttgccttgcatccctgaggtctcagaagggcctaggcttgaaaggacttgtttccccagaaatcaagcaagtaagaaaataaattgacaacatacttagaggagaagcctatcaaacttccaggggaaaacctgggattaggggaagccaggaagagcatggctgagccagaaagggtggagcacatgaatctcatggagatgagccataaggcaggaagttgagaatcagaacagctgatttagaacagaccagtacctccttatggatctgacactgtgtatggtccagtggaatctgcaatgaggctgtgagttgagcagcaaagtcagggcaaggcaaactgttcttggagccatggacaacaggagagtatttcttcagggccagtgatacagggggcctgagaagagggactcaggatggagccctctgggagctgcctcagcaatgctgtctggacactgatcatttaatgagagggacccctgggcttagagccacaccacatcttcccacctccttcaagggctcctcaccatttctacctcaccccaatttccttcttctctaagaggagcagctgctcagacactgattccctggaggaagcagatgctcagctgagcagaagggttgaccctgcatgggtgtgtcacgtgtgtccgtgtaaagagagtccaccaacaggctctgtgtgagcaacaaggctgtttatttcatctgagtgcaggcgggctggtccgaaaaaggagtcagcaaagggtggtgggattattattagctcatataggtttgggataggcatacaaagtacattctcaaaggcggggagaatattacaaagtacctttttaagggcaggggacactatatcgtatcagttagggtggggcaggaaaaaatcacaatggtggaatgtcatcagttaaggctattttcgcttattttgtggatcttcagttgtttcaggccatctggatggatacatgcaggtcacaggggatgtgatggcttagcttgggctcagaggcctgacagggtggtgtatgtttagggccgttccactgtatagggtcccagtgagtgcgctgctcacagaaggaatatgcaacatctcctggctccacattggtgattgtgagtatgaaattcctcccagacccactgccactgacgtgggctgggacccaggagcccggtttgtcaccatatagatcagtggttgaggagattggtgtggcttctgttggaaaccgttcaagtagatgtctccattcctatggatgagattgcgactggtcttgcaggagacggagaccctgtctcccacggccacagacaggagggatgggggctgagtcatcacagtagcctgatgggaaagggtggaaaaacaattgatcagtctgaatacaagtcaaaaacaatggttgtgaatgaaaaaaaagatacatcatatctaggtgttcttcaggtttttaagcctctgccatctgaatgaaaggctgaaataaaaactttggccattgatcttcactgtctcacccactggataagagtggccaccactgttctcatcctgaaaattacttatatgtacaaagaatcctgtaccatgaatgcagagcaccaggggcaagaggatccatcccaacaagaccatcctgggcagaggaatcatccagaagtgtgttttcagcctagatgagcagaatcagataacaggttcactttcacaccttagatggagtggtcaaatagcccatgtatgtttctatgcaaaagaccttgagtgctaggcattcatctctgaacctcagtcaaagcttcctatgagagagaatgcctcgctgcggctcccaggccggctgtattcagatgcctgggcatggtccaaccatgggctcaggttgagcagaatcatgatttaacgataaatatcccaggggtcagctgaccttctgaagtgtcaaacatgatattaaaggatcaatatgggaaaggaaaaatgtcactaggttgtgatttttcatttagttcagagagctatttcttctgctcatttttctttcctgaatggagtcatagatataaatctaaccaaatatacaattttcattgtcctcttaatcattggcaaactatatctacacttctggagcatccgggaagctagcccataccagtgctatctttggagccaggtggtaactgtggatgtgagcaaatgacagttagatctacaagtctccaagaccatgaccactggcctgggaggacctgcagggtttgcatgtcctcacacctggatgaagaacatcttgatccttgtccttttgatgcccttcaattactaggccacactccaaaaacctagtcctcactcctctcctttgctagacagaccctctcactcacagctcttcctcatggacatttcctgtgaatcatttctccaggcttacacacactctgcatgtcacagtatgtgacagagggaactgatgtttaaacaattacccattgattaggttgttctgagtcctaagtttaattgtccttctacaatagagtcagctagaaaaataagaaacgcgaagaggtgtaaaattattagtgcgtgaaaatggtaagctatgaactgggatgatgaagtaataatagtaatagtaataataataataataataataataatagtaattaataatacccagaaccggccgggactctgggcccttgttaatccgagataccagagccctctctaggatcgctattgcgcacgtgccccttcttgtggtcaactccgccaagacacctggtgttttttcccggtaggtacttgacagtgtcattcctagtgaataaggtaagtcttttttgcatattctcaaacacgctttcttgtttgtttgcttggcttgttcatgatgcctaaaacaatcataaatggttttcaggcactatccaagactgtggaaacataagcgagtggtgggtagctttcagttagatgttaatacctatgaattgggatttcctcatgtctggtttccaagtgttgtggaggccacacaatatgttgctgtccaacgctctctagttagcaatagagtgaccgtaagtttatcagacttgaggcccacagcggctcagtcggtgatttcttactccactctttcgttgttccctcagtcggaatctgtgggcagtttccactatgtctgtgcctctggcctctctcagctcccctgcagtgctgggggtcgaggctgatggctgcacagagaaaggtcttcgtattatcagctctggctagagctcaagttcagagcaggacagtgccctccagatgattatagagcagaaagactgcctcttctatcttctctaaatggagtacattctagatttttatgaaatatttacattccagtatttatggaatgatttaaattatttttcaaaactgtattggaagctgtgtctgaaggcgaggagcaatgcttttttttttttttttttttttttttttgaaacggcgtttccctcttgttgctcatgctaatggctagactgcaatggcatcgtcttgacagtctgcaacctccgcctctggggttcaagctattctcctgcctcagcctcccaaattgctgggattacaggcggagcaatgcttttgaaaatggctttgctctctggttccacacaaggcactgaagcctgcggaatttagggcttcacgtgggttcgagggtcccaggctgccacctcatcactcagcctccttttcttgcccagtgctctgtgttctttctctggtcaggaaattctcacacattttggtctaaaatggaaggagtgttgcttctttcacctgaggatcaatcaatttacaatttttgagacaataatttacacttaattaaatcaaatcactttcatcatatttgtctagaaatgattttattctttttatttattacaaattgcctcatggcctgaccaaacttccagtggatcacttgcaagagcaaatttaactgtcaaatttaccgttacattcatccattgagttattggtttgaattactttatatttgacatttgtttgatttctttttatagtttctggttctctgctaaaattcttgatcttgtcatagaatgcattcagcatataatatactattgtcccaatatccgcaaattattttggtccctttctgttgcctgttttttttctctccattttgtatgtttgggtattgttgattgaaatcacactatgtttaatacacttaatatctatgtagatttaaactgatacttgccctacaacattttagaagcaattttgggctctggaataattttcacactccagagaggatttacttcttattctgccagaatgaaatgctagggctgtaccaagttaatgccatcaaaggactgcagtactttgggcctgggtatcaacacggtggtgccttgctactcctggtgcaacctcctcccggtatgtttccctagcaagatttcacctcaagaccttggtatgtgtcaggatccctccttttctgcagtcgttcgggacagtttttcacctgtggccatatgagatttttttaaagctctgatggactccgaggccccttggcccctcctttctttcagattttcaggactgggcctctatttctgagcctgcttatgtctcaagggacactgaaggcacaaaactagtgctcccctgtctatgcttccctgcttttcttgtctccttgaagacctgctgggttgtaatgtttaatgccccatcatggaggtagatgggccggtttcctaattaataattattaagttgaggccaagaaaacttgagagagtgtttattgttcccacgaaggatgcctgtgtggggtgggcacgagctggtgcagacctgcctgaagaggcagagtttaggcttttagagttggtaaggggagagagtgagagaatgttctccctgtgagctggagggttgtggggaatttcctaccagtgcttatagagatatgggcagagaaaaaaggaggaggggcttggaggatgtcagggataaaacatcaaaagtaatcagactctcagacatggtgatgctctaatgccttcaaacacgttttcatattttattcagctttttttaggtgtacccagcaggttggttccacataagccattccaccattttacagaagtggaagttgcaaaacaatttttaaattatgaaatggttcaaattttaaaatatggtgagaaatattatatatataattaccgggtggagcaaaataatgataaataatgttatcaaatgtttactatttataaacattttaaaaacatctattcaactcataatactgtatgatatagttattcctttattttttattattacagatgggaaaaccaagcaaagaaagtttaagtaacgtcctgaaagtcacacagctgttaagtggatgagcccaaattcccatcaaatgtgtatggttttggttcctgtctttcatcatgggataaagtagtatccaaaggccctttctgaggggttcattagatttcccacttagatatcagtcattttgacaagagaaacgagtggattggtgtcctctcgctgtccagagttctcacaccgtgacaggcaagctcctatgttgttgacagtaacaatacgctgcatcttcagcctccaggctgctgatggaggggatgaaatcagtccacccactgtcactaatcctggcaaggacagcaaggtgcaggtcataattactataaataataagattcagaacctgacctggtttttgttggctccaattcaggcagctacaaatatcgtcacagcttctcagctgatggtggcctttcaacttctctcaggaagctttgtctggaagttttgtaagtttgggcacgataatgttcccattgacaactgaaatgaaaaaaaaaatcacatgaaaaatggtgatgtaattgaggttaaatacatcacacttcatggtcttctcaggtcactcaagtgtgtgagttcctcgtgagaagtcacaattcacagatgcaaaaaagccctcagaactcatcttacaatgagaagaaaggctgtttccttatcatgtgggagcctcataatttcagctcctaactgtgagcaaggcaactgtctcagaccaattccactgagtcagggtgaagtcagacaggcgcacacacagtaagaatcgcaggatactaaactggattctgccaataccaggctgagtcactgctcagccctaactgatcaagctgtttttggagaccagagcctgagtcagcacagtgattactgtgacatctaattcagaaatagaacacaaacacatcaaatatttttctgaaaatataagtgttatgaaatgatatttcctaagctatcaaatatcttaagaaatatttcctttatttctaatgcttgtccttacttcatgatatgcacaatttccccactccaaccagtatgtattctatttagatcataagatacgattagtggttatgtttatgtttgccactcaatatcagcagtatagtactccaaaatctcaaattgctagaacggcattgtataaaatctttaagtgaagtgataatccacaaataaacatgaatttcagatttataaaaagaaatgaaaacacaaatgtcctagtagagcaggataaaatacacttttctacacacagagtaaagggtaaaaattataaagggaaatatagttgcacatataagcaatttttaaaaatcaactgctattggctgtgcaaacctcagtcccatcaactctctcactgaaatatttctcaggtttatatctctatcccctccaacatctcgataaccacaaggagccttaagaatgatgttgctcatgttctaatctctcactgtctagtttgataagttatgttgacaactgcacaataagagcgataagatcaaaagactactgaagacatttcaaatggaaaaactaaaagtcaatatctctcataaacatagacaaacattcaaaaaaaaagggaagatttacctctatctctctcagataatctgccatgcccaacttgaatatatttcagaagtgcaaggttattataacattacataatcaatccatataatgcatcatactgacagaattaagaacaataactttcattatctcaatagtagctgaaaatcacttgaaagaagtcaacagctattcacaataaaactctcagcaagcctgggataatggaaaacatcttattctgataaagcatctacaaatgatccatctttagaattactgaggtttaaaattattgagaagtggtacaggcaattctacagcaaacatcttacttagtgataaaatattaaacatttcacttctcaaattataaaaaatactgaaccatccactatatgaaatcataatggaggtcctaagacatgcaaaaattcaaaacaaataaacaaacaaaacccatggagtatggaaatgaataagcaaaacatttgtatttgctgataaactttgtacataagttcttaaagaatctaaaacttaatcactagaaataggtctctgcatacaatgtggattaaaggagatataaataaatagcattttcatgtccatagaacagaagatttgatattgttaagagttaatgggtgcagcacaccaacatggcacatgtatacatatgtaacaaacctgcacgttgtgcacatgtaccctaaaacttaaagtataataaaaaaaaaagatttcagttttctccaatttgatatatagactcaatgcagtccaattaaaatcctcaaaggaatttttgaaattgaaaaggtgattctacaatttacttggaaattcaaaggacgtagaatagccaagaaaatcttaagtctaaaaatctggtattatgtcttctgactttttttttctttataataaagccacagtaattaagactgtactgtaagtacagagatagacaaagagtcaagaaaaatattctttttactcaatcatgagatttttaaacacaggcaatagagtgaggtataggttttcaattgttttttgttttgttgtgttttgctctatttttgcaagaaatggtgaggagttgttgagtatgaaaataaaaataaataaaacaagacatcaaaatacaattcttgatccacctcaccccaggcaaaaaacatgaattagagatagactgtagcctatatgtgagaggtaaaataacgatgcttcttcaagaaagcataggagcatatctttaagccctttggtggtaaaaatttattaaacagaggacacatgtaaacacacaaaacaaacacaggagaaaaaaatgacaagtaaaatgacaaattagattacattataattaagaacttctaatcgtatcaatgtgtatgattaatataacattacacacacagacactcacacacatgatttgaacaggaacttccctaaagatacgcaaacagccaatgaaaataaatatatgaaaagtgactcaacatcattacctattaaggaagtataaattttaatcatgatacaacttcagatttatcagtacagatgttttgtgctggatatgtatagtggaactttgacataattgactccatctcagataaagactgcattatatgtttcatagggcagcttgccaacaagaataaaatgttttgcctacaaaataaaaaaaataaaggctgcatccaaccagataaggtcacaagcaagcacagtcttgcactatgagttcttaccagaggactctgtgaccatgaaagtgcgggctgtcagtatctcaaaagggccatcttaattcacaaccatcccgttgtcatttgtggtaagaactcctcatctgtctaagaaggctctgacacatcagagactcttccttgcaaggaccaagggaccttcaggccagaccaggattctttttgtcttcttcactacccctggattgatttgataactctttctcctattttttttcttttggtgttaaatgttgcattgtgtaaactttaacttataatgtttatgtattgattaagaatactattatgtatggtttgcaatattgaccggcttgtgcaatggttttagcctgtgtgcccgcaacactgacaattgaatggctccttgggagctccatgtagcttgcagcttctgtgttggaaatagcatcagtaaaagtctgacattgtggaaagacataaacacacatgggcctggttaactctgaccttggagtgcacatgacagggtagatctatgcaaacttgaccccaatgcctgaggaagctgaaaggctgaagaaagaggccgacacatccagtttctcagaaagaaacatttaatagagacttaaaaacagaagccgtgtctgtgtctctgacagtaggcagataagatggtcaatcacttgccatgacccctctcaaatagggcttgtataccataggagaccagtggttcagaaaggatgtgtacgacaatcaaagaatgattacatcaaggttgtttaagggcaggatttatgctaagtacttgctcttaaataagataaaatagataaactgaaaatcttagagaccgtcccagaactcaggttaatcagaagtcagacatggaaaattagcatccaagatggggttgctttggcctccaccctagatataataaaagtttgacagtactgagtactgaaaaagattgacagcaattgagacttttatgacgtggttggtttcacgtaaatatgttcagtatttcagtaaactattgtcaatgtttactaagacaaaatctatgctaactttataactcaacacttccattcttaggaatattcccaagagaaatgagtgcataagttcacaaaagacaagcacaagaatgttcttaaggtttttaccagtaatattcttaaaccaaaaacaaatcattagttgaaaaatgaatatattttggcatattcatggaaaattgtgcctcaataaaaaggcacaaattactgccagagaaacaacacagatgaaactcaaaaatattttgatcaaaataagcaaaacgtcaaagagtaaatactgtatgattgaaattatataaagcttaagtataggaaaaattaataaatattgaaataaaatacagcggaagcctaggatgatgatagatggaacacggaattgacagggaagtaacctggggagatatttgagatgctgggaagagtgtggatcttgatctgggtagtgttggaagaaggtgggatcggagcataaatgtttacagtatacatataggtgcaatacgtttatctgatatattgttggctgaacatacttatatgtgtatgtacttatgtctgatctttgaaaggtcataatttagactctaatcccctgtatcaaaaaaaaattctttaaaaatatgtagagtaccttctccttttctgtataagtctgacttttgctgcaatctagacctcctaggtttaattttctttgtcctttattaataataatcaggagagatacttgcatatcagctgatggagctgaggataaagagagatagaatgtaaatgtgcctccctgaccccttctaccaaaacttcccagtgagcttcaaaccttggctgcatctgagaactgctgtcagcagacggcggcaccaggaggagcagctggggcagcccagactcacacatctacttccctccatggtttatgttcaggcttgtatcacagtgggaggggcactgttatacttttgacagtaataagttgcaacatcttcaggctgcaggctgctgatggtgagagtgaaatctgtcccagatccactgccactgaaccgagatgggaccccctgattgcaaagcggatgcagcatagatcaggagcttaggaactttccctggtttctgctgataccaggctaaataattgctaatgccctgactcgcccggcaagtgatggtgactctgtctcctacagatgcagacagggaggatggagactgggtcatctggatgtcacatctggtatctgatattaggaacataaaaacacatatccacatgattagtaatgttctaagaagaatttcctgaagtgccaggcattaatggctacactggctgaataaaatttttgttgtttccctccttacctgggagccagagcagcaggagtcccaggagctgagcgggggccctcatgtccatgctgtgtccggactgagagagacttctgcacaggatgtcaccagcctattgataaatgttcagggcagtaggcgttgctctgtgggacatgcaaatctgcacagctgcaaagatgacttatctcaataacactgcacaggcccagtgcctcccaggtgtccaaagtctgcagagcatgtgtttctccctgcaggctacaggaaagaatcagcctactgtcctatgtgtggagtgttcttttgctctcttcatgtttcatgacatgcttctcttgctagctttctatttatgataaggtctgctagggaaaaacatctctagaaactcaagaaattttagaagtttcctgcatttgatacagatgagtactattaaggtcagagagacttcctttttggtccaattccctggaaacaccagtgctgtaaattgtcagtgctaccaacaatggatgcattaaggtataatcatgaatgatagatagatagatagatagatagatagatagatagatagatagatagatttgctcattaaaaaagaaataaaaaacttaaaaaaaccctaatacttgaaaataatgccacagcaaggaagggtcctgccactggctatctggcatagctaatctcccatctccagacacataattgttatcctccatatctgaatgttctttcctacctctttcagctgggccagccaacatgataaattttctccctttacttctgaaagttctcagctatattctagctctgtatgccatcctacagtctcatgctagatatttccctgtgctccctgaattttatttatgccttttatttctcttatccaagccattccccttcagaagctgaggtgtcctctaaaccaagttgtcaccctctatccctgtgactactctgtttcttatacctgcacatttccaaatcaccaatctcttccagctcctaagagaaaacagttcttaatgactgggtttagggcacttgatccgagcaggttcagaaagaaaactatgcaacaaaaagccagggaattgtatgagatactgagcctacacaatatagaaagtgcacccgtgttgtggggtgtagaggaaagcctacctgtgcgttgaagctatagttagcagagacaagtatccctacctgggtgtgcaggatgcaagacccctcatcccacttatgcaggacatcacagctggatgaggatgagcaggacagtcacaagggtggaggacactgttgctaatgtcagagccccgggggggaaagggcagctatgcagggatgcaaagttcacggtggactggcacggagtatcaagactaatgaaggtgtgtgaggcataagagggaagttgtccgcaaggaaagtttaggtgacagggacagtgggagattggtgtcacacaaaatgtttgatcatttaagtaaatatggtatgaataattacagccaagattctcagtttggaaaaaaagctacaaatataaaaaaggagaaactgtagatgtggattgtaattagagacattaatgtagattcactaatttttggagagttttatacggatatagattaaaacatatgcagatagacaggtaatttttcctagaagcagtaacacacaagtctcaataaacaccttgagtgctcaaatcttgttttattgaatatcaatctctattaaaaagaataattactggaaaaatatctgatctcaggtttagagcagaaaaaatataagatgagcctgcatttcttgtgtcagaaactaaggaagtgctcagaaaatgatggggtaagagaaaaagttattaggagctagcttgaatggggctccccttggacaaaataggggaatgttgactctgaaaataaataatgatagtaacatatttgtttcagtatgtgctgttataacagaatatttgaaactgggtaatttatcttttcagttagaaatctatttctcacagttctggaggtgggaaagtcaaataccaaggtgcagttatctggcaaggtccttctggctgcatctccatggtggaaaggcaagacagagtgagtaagagcaagaaggggtcaaacttgtttttataagtaacgcactctcactataacaaactcacccccatcatgatgacattaaccattcatgagggcaaagctctagtgacctaattacctcttaaagtttccacttctcaacatggctgcattggggagtaaatttctaacaaatgaactgaggaggatacattcaaatcacagcattccaccctactctctccagttcatgtccttttcacatgaaaaatacattcattttatcccaatagcacctaaagtctcaatttggtccagcatcaactcaaaagtccaaagtccagagcctcatctgaatcacatatgggtgagattcgaggcactatttatcccaggcaaattaattccagctataagcctgtgaattatcaagttacatgcttccaaaatacaattagccctccctacccatgggttttacatccacagattcaacaaccatggattgaaaatagagtattcagcagatgcagaatccacagatgcagagggtatacttttcatatttgcaggttcttcagagctgactgcaggacttgaatgtccacaaattatggtatttgtggaggaccctggaaccaattctccatggaaactgagggacaactgtacaatggtggggcaggcataagataaacattctcattccaaaaaagagagataggtaaaaagaaaggtttaactggtcccaagtaagcccaaaacccaacaggaaaaacattaagtcttaaaggtggagaataatctttgacttcaaatctcatatctggggcaatctggggtgggagttggtttaccaatgcctcaggcagccccacctctatggttttactgggctcacttcacccagaagccttcatgggttggagtcttgtgcctgcatctttcccaggctggagttgcatgctgctggccctacaattctgtggtctcccaggctgcctcactttcatggctctactagatattgccctagcagggattttctgtggaggctttctccctgctacaagtctctgcctgggatccagtatgtccatagtctttcccaagactcaatctggcattctccttgctgggaatccagagccactctccggctatcctttttggaattcagccctaagcccctggaagcttttcttttaaaccctccaaacacaacctctgacaggaatctggctggaacagtcggcatcttcagcaaaaacaactgagaagcaggggaaccctgcaaacaccacattagtgtagaggaaatgcatacaatccctagatttcatgttttctccaactgttttttccagtttcttaaccatgattctgtttctatgatcttgaaggatggagacattaagaagaacaaggagctgtttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccaaggagctgttttatgcttaagatataaaaagagaaatggagacaggaagagagcagaatttatacattcttcaaagtggtttggatttctctaaccatgggcatagaatgacaaagatgttaggagaagacatcactttttctgatttcctgtttttttgtgtcttagactcccataaacacaaataagaacccagtcagtctctttcccttgaatattttttctggataagttaaaataattttagaagcaattgcaagaaatgatagcaatagctgaagcagagataagaattctgaagtttggaacatttgaggttggtgcagcaacttggtgacagcaaaaggacccaggtttttgctacatttcttctttgcacttcagtttttcagtcttgggttcaaagcctcatgatcttaggagggctgcagtgcctccaagtatcaatgtgcacgcatacctgtttcaggaaaaaaaatgcaggacaaagctcttcaccttctatgcctttatgagggatcaaagtccttccctgaagtgctgctcacctctgacatctcattgtggagctcatgtgccccactccctgctcctcttcattgtccttgccatgtgcagcagggcgaagctgctcccttatacgcccaaggagaggggatggctgctgtgtaggtgccaagagttttgcaatgttgtatttcactatgtgtctaagttaagttgcatgggaaagagaaagttcaagggcctctttatgtggtgggattggagtgggccagaccctgaggatgacaatgaagtcaaatttctagtttttcagttgccaatgctggcttcactagttaaggaaatgtggcctgtgcaattaagaccaggacagactttcaggtactggaataaatgggggagttatttggcatagggtcctcagtccaggactaatgtttgcattacccaagctgccggtcactggccctggtctgtggcagtagcagcttctctcctgaaccatggggctgaggacctggggggaaccacaggccctatccacggggctgcatggaatggggcttcagagaaggaaactgctcacacacccacgggtgccacaccaagcccagagcccgaggtgaggatgaaagtctctgagaccagagccttagggctgggcctgggctcctggggctggctgtcctcagctctgtcctcactggtcctgagacaccaggaccctgttggagccaaagagggagagtcagcaaatgtccacagactttactcagcgagcctctgttctgcttagaaataaaaggaacacatgctacaaaaataatgaatatatggacatactatgtaaacttttaaattaaatagatataatattatggatataaattattgatgtatctgtatataatatgtatctatattatacatctacataatatgtatatttatatagaaatagatataactgttggtataaggtatgatttcaaatttgataaattgagcatgaacatttaaaaccagcaatagcacaccataaacatgatccttcctgacttcctgaaggtcaggaagctcaggacccttccccatgtccctgttgagcaggacagagagcccccaagacccaaggggggtgtggggaacacaatcagcaggtggctgggagatgggcagtgggtctgggccctgattggagagaagttttgttcccagatctccgagtagacagttcctcccctgggggctcttctcagacacagcagcacatgtgactcagtggctgtgtagtcacagggtcacaggacaaaacccttccacttggcaattggcagcttctcctctgactagagtgatgtgggatctctctgcccagctatcatggctcatgtggctgctgacatcctcttcacaaaacgagatgccatgaaggcagctcagctgctgatggcccgagtgaactctgtccaagcccatcacccctgacccaacaggcattgtgtagagtaggcagcaggagccagcagaagctcagagccagctgtggcttctgctggtgccaggctagaacattgttgagactatggctggccctgcaggtgacagtgaccctctctactagtacacatgaagaggggctagagactgtccatctaaatgtggaataaacatgaacaccccaaatattaataccaagcatgtagtttgttcagtttggttaaattctattcagaaaataaaacaggctaattaactgattgtcaaggaaacattcctgtttattgcaaacaaactgaagatgaagcctgaaccctcccttcttcctcaagagagagtcagaacagcaggaggaataggagcaaagctgggtccccacgtccatgagatatttcttgatgctgatcctgctcagagagggtggggatagtgaatgagccttctttcactgcaacaccaaaatactctgggtgggtggcttgaaccatagacatttattttcacatttctgatggctgggaagtccaacatcaaggtccagcagggttcaatttctggtaaagaccttcttcctggtttgtagatgctaccttctcaccatgctttcatatggtctttccatatgagtgtgggagttagagagagaggaaaaagagagatctctggatcttatgagaaccactaatcctattggatcagggccccacccttataacttccattatattcttataggtcctatctcctacagccacgttggagattagaccttcaacatgaatgtgggaacacaatttagaccacagcaggtggacacaggtaaggcagtagggagggaaaggatatgctttcagcctccaagcacagagcaggttccccacaactcagcacactggcagctcatcccagatgtcccaggtcacacatgagacaccgttctagatttagggacttctcattgataatcggacactatcagtcttattttcccagtgtttctaagaccttggtgttctttattgtggagtgtgtttacacccagagacaggttattgacatagcaatttatgggatttttaattttgttatagtgaaaattacttaataaatttatcagaaataataaactaaaattaatatattgtatgaaaatgagattaactgaatatcctaaaaggagcctgagaggataaaaaaccatattcttttcagaagaggacaattaaagtcatatgacttttataacaaagacattttagtagaaattatcaaatgataaattcaaataggctgccacaaacataactatatactcaaaaaattattttccaaaataattttacattatcatataagagcaaataactgccaggtgcagtggctcacgcctataatcccagcactttggaaggctaaggcaggtggatcgcttcagatcaggagttcgacaccaccctggccaacatggtgaaaccctgtctctactaaaaatacaaaaattagcctggaatggtggtgggtgcctgtaatcccagctgctccggaggctgaggcatgagaatctcttgaacccaggaggcagtttgcagtgagccgagatcatgtcactgcgctctagcctgggtgacagagagagactccatctgaaaacacaacacaacaaaacaaacaaacaaaacaaagtgggtttatcagcagatccactaaatggaaaatttctccaatgcgtgcttaaagtaaaagaacatttatccctgatgggaaactctagatttctttggtctttagaagaaaacagctttctctctagtcgttccacttcatgctgtcgaggatgggcatgggggcaagtgactctgaggaaggaggaaggctgtgtctgagggtggtcgtgtctcctgcccatctgagtgacctcttggagaagagccaccgacaccaccaaagccacccacctgcctctgcactgtcaggcaacagacacagaaaccatgtcacatttagtccaccatattttgaggcttctttgtaacagccttaattgtactctgattctccttggtatttcatctcagtttttggaatcatttatttttcacctaatggggccttaacatgtgggactgaagtacagctgaggctatcatgagccagagtcctcagcagcaacctctgccctgaggtctccaacagcctcctcttctgcagactcagagaccctgctgagctgctctccagacaagcagcacatgtgagcaactgggcaaccccaggaggaggtttctgttaggggttgtaccactgtgggaggagtttgtagagcttgcatgcagtaataaaccccaacatcctcagcctccactctgctgattttcagtgtaaaatctgtgcctgatccactgccactgaacctgtcagggaccccggaggcccgattagaacccaaatagatcaggagctgtggagactgccctggcttctgcaggtaccaatccaaatagttgtatccattactatgcaggaggctctgactagacctgcaggagatggaggccggctctccaggggtgacgggcagggagagtggagactgagtcatcacaatatccccactggatcctgaaataatgaattgcaaagttatgtacaaacctaatgagcaattttcataatttatcttatgtcatttatttaaacttaattttaaaaaatactgatttatgccataaaaatacacattctaaaatgaattcaatttttgtaaagtataagagacctttatattttgaaaatcttaatcggagcaccagacgtcatatttcttatgaggcttctaattattcacagagcaaaatatcaagttcccttttctacagcacagattatactcctctaacacagggttagactaaacatgggatcatgggatgctgtggagccctagagctcaccctcccaccctattctccttcctcatctccttcttttcttaccagagacccagagcattagcagccccaggagctgagcagggagcctcattgtgagaaggtgaactgaggagtcctgatcagtcaaggcacagttacagctgagcttttatctcagactcacaagggaaggtcctccctgtgggacaatatgcaaatcccctggtgcatgcagtggtgtggaaagagtcaatggggcaggcgggcaggggatatgtctctcctgtgagcaatgtgatataaaatgggaggaaggatctgactgtgacagtttgaatcttgggtaggtcccattgtgtaggatatgcaactctaggaaagcataacaaccctaacaatgtagagatatgtctagaatgaatatggatgaatgccattcttcttggctccctcccagctaatctaaaaaaggaaacgttaccctttcctacaaacactgatgagcagacagcctacaaataaaacatagtcttgagccagttcaagagtggtctggtatctgcggtttccaggataactgttcaagaatgttcatagcaagtgttggaatctaccctcccctggcacctggtgagtgagccccataagagcgctctgtccaagggcctcatagggaaaataatgtgggtctctatatttagattcaagagcccagtgcaggtaagaggaaagtgggaaacaatttattcctcaggcagtgaatataaaattcctggtgaccaattgttcaatctggtatatattccatcataatcatctcacatatgctagattaacctgaaggatttattaagggaagacttttctaggataattatatagaatgaacaaaaactaactttgcactatgtttttctgaatggtgttaacaaaagctcttcccacagtcttcctcatcatgtggaatgaggtcctatcaggacttccagtttttcgtcaactaccaagtgagatctgagtgtcccctgggcctgtaagtggtgcagccacagccatgagttcacaatttgagtggaaattctctatgtaagaagagcacgaactggatccacagctttactgtctcatggtcaccattacccatgactggcattttcctgagctttcatgtaaagacgatcacagctcagagatgtcaatctaccacacagctgatcatgaaaacagggaaacaatccaactatttgtttgtcaatgatatgctcaagattgagttgaacagctcttgaaagattgtgcctacatcagatcccttcacaaggacactcactgtcctggagagaaaacatctggggagagccaacgtaatagattgcagtactatgtaatctcgggtaatttaacccaaagtcatgcttacttggtaaaaaacacaaacaaatgcagttctaagtatgatcccacaagaaagcttggtctgcatatcttttgggaaatctaccaaaataagactttttaacaagattggaaaaagtaattgagtaaaaatgatcttaaatgtcgaactccatgttaatattctgagttgatgaccacaaattatcatgaggaggtaggagtacaataaaagtcttatatttcagtctttaaaatatttattattttcttttatttaattttgtaagttttgtgtatttaacttttttatcccatgatgttgaccaattcaatgcaggttcttagtcttgaaaatttcagactcttaattaatcatgctagtgaaaggattcagaaatattggtaggtggaaagaaaaaataataaatgcaaactaaacctaacatactaacaaaaaagaacactattgaatgcattatgtctggttttaaaggattactctgaaagtatgttaaatgaaggatcagttctatctactatctaatatggatgcttgaattgagagaaaatgacaaatgataaaaatctgtcgtgctttcttttgcaaggcaattcaagaatatgttatttttacaaaatattctttaatatttttgaatttcagagagtattgctattcgctatgaaaattaacaacaaagctttaaggagtctgccattgtatttggtaatttacttcagaatctgttgcccttacgtattcagaaaatgtaaaatcttataaaaattatttggtgcaaaaaaaagctttgaaactaccctatactatctatgtacttaaataataatatttctaattccaaatagaaatctctgtctcccaaacattaacacattatgccaaggctttgataacaatggacgaagcaggtggctccacagtggacacaggtaagaaggtgtaagaacagtctccatttgatccaggtgggaagcaggcctctgtgtgtctctaatctgaaccatggtcatctgaatgaggaaggactgatacaggtggatcttactgtagttgtgtctcctttgcctgatgctgtgagatcggagcccataaaattggaagtaagtatattacttgtatgacatgggaagataatcatggaaatggaagtgtttgtgtccttggaagtcagtgtttgtggggttggatggagagtgtgatcctgttgtttgtagatcatttgaggactttggagcctgggcaaagaaaaagagatgtccacaggatggcagtagcgcacacaacttttactgggtgaagctttgacaggtttgccggtagttcctgagcaagagtctgtctataggccaaggggccaaggttgttattcagaaggggaggaggaagaaatttgctgtataaggggcttatgtgtctaggtgttgtcacacagcagtgttggggtgatcagacccaacaccaggtcatggggatgaccaagtctggtggagtcaaaggattgagaaaagacagtttgagaagtaaagtgggaccagggggccatcgtgatcatggaggctgtgaaggccccgagctctgggagcccagtgctatttattggttatccaacaaagaaaaaggtggtgagaatgtggaggtcaaaagggcgcgttgcattaggcacaagatttatagctgtgatggtttagcattcgctctgctacttgagataatggagagcaggttcctttaactcaagatacaatcgaacctgggagagcaaggagcaaggagccagcaagtgtagacacattccagagccatgaaccctggattctatccaagccatgagggattttatgccctgggcttagattacggtgtgtcagggtagccttccaccctttatagcacagagcttggtgttccaaacgccacaatgggttttagaccctggaccccagacatgttccaagactgttttacattatgtcagacatgcaagccctgcttaagcttctcccaacactcagcttttcccaatacagcagcacaatggggagtctctaggtcagagagaaccagagggaaatattagtctggggttttcataacctggtgcttacctatttctagcagatgtgagcaaggttctctgagatacataatgtaagcattctttacatggcaaaaaatctgctttggggggctgtttttgaaatgattggattgtaaagtttgagtttggcacaggccatagagaaataagctgcaatttggaaacaaacaacatatgggcagttcacacaagacacctttggctcacttatacatcattgttgcacattttgtagactttgttctaaagactatattagtgcagatagacaaaatccacactgctatggatgagactgaagacacgctgcagtcttttccccacctggacctcaatggaggtttttaaattttttgttaaagttgaaagtttgtccttggtgagaaccgagaccaagccacccacagagggagcttcactttgtgaagctgcaggtcctctgcgctggatttctggcttccagggcacgtgagattgaagttgtctgcattatctcatcagctgaaaattgtgaccaactggagcacagattcatggataaatatccaggtacacagagaacacagggaatgagggctctgtggataggtatcttctgcttctgagaatctctctaaacactgggagacacagggatatttacatatttgacctttctgaatcttcagaccctgttcttgatcagcctaatctgagcctgtttccaaatgtttcaattgattgtcctctttcttagaaaaaaacagaaaaaaaatgatataaagtatacactgagatatgagattagctagtggagtcctgtgcttccagggatgcttttcctccgtgcatgttcatctttctgtggggcccatctcacccccatcagactgcacaaagtgaggcagtgattttgttgcatccctaagcattctgtgtcccttacattctttattccctctaagattccttctcagttctgacccttaaataaagggatctctgtccctgaaataaggtctccaaaaaaccacagcttccctgggtgtttataaggtttttacattgttgagctgctattctgaccactattaagaattaatttctattccaagcaaattacctttattaaatctcaaaaccacatgccagctataaaagcttgctcttttttggaagcatactcaagaatataattgcccagtaaatatttcctttaatttaacaagttaatcagcagatttcttctttttcttttgtcttagataattttggtgcagtcgagctccccagtaagttgtttaatataaattcccataattgggtttaaatttcttctagggctgctatattccatcctacgcaagaatcaaataatctttgagttttggagttcactagtttccaaagcaagaataggaaacatgtgtaagagctgcctaaataagtaactaacaagtcatcctagcctccagctatttgtaaactttgtgatttcatcagacgactgttctagggaaaacaaaattatttattttattctattctatttaattgtcatttactactaatatttcattttttggttggcataagggtaattttagaagagctaacatgtacatttctaaaagtactaaaaggtgaggccaattgtccttcaaggagcacttaaactttggattattctctctcggccaagaaaagccaagatagatgttgacatggtttggatatttatcccactcaaatctcatgttgaaatataattcccaatgttgaagatggggcctggtgggaggtttgggggtcatgggggtgcatccctcatggtttagtactgtcatgatgatgagtactttgtgagatctggttgtttaaacacatgtggtacctcacgccactccccacctgccttgttcccacttaagccatgggatatgcctgctcctgcttcaccttctgtcataagtaaaacttccctcaggcctccccagaagccaagcagatgcccacaccatgtgtgcacagcctgcagaactgtaagccaattgaacacctttcctttataaattacccagtctcacgtttccctgattccaaaagtgaagtttatactatgctactgctaccacattagaggcaattcaccatttccacctgctagtgcagagcttgtgttattatttaagactaagaatggccactgaataattcattcagcccgtggctctttcatgttctgaattttggatttttggtaacttggtatggaattaaatggttgaaagaatacttttgttaattttggaaatcaacagaagttatttagtttggtcttttattcttccttgggatcttaaaatagccttattcaaaatctgtaaaagccctggcccccattcatacagaagaagagcccgtgccccttactgaggcctcatggcctccttaactcaaaggctctccagccacctccacctgagtttggtgtggatgcatcctctgggcaccacagctgctcctgccacactgagaggctgagcctttttggaaggtttgtgtttggggccttcacactgtgcagggccccggtgagtgtcctgctcacaggagtctgtgcactgtctctaggctccacactgacaattatgcaagtgaaatcaatccaattttggttaaatgtgtgcatgtgtattcaacttgttttgctacaaagcggcctgagttttctggctgttctgctacctgtatttgttaggcatctgcacaccagcagaaagaatcaagatgagctttcattgagcctttcctctggcaagatgtggctcagagcccactgcatcctcctttctgctgttgttctgccctgccgaggctcttgcagctgaaggggcctttaaatatgtcacatattcttccattgttaaatgtgagataatttgttttgctctgcaggaaagcttcattcacttgaagaaggagattaaagatttctaaagcaggatgctaatcttttgatctttgtgcaattttgttattaaagctgtctctttctgagagtaaaagaggtataatttgatttaaaagtttccagctttaacatctgtcaatgtaagccttccaaagaaaattctggcactgctcaagtcaactaaatattttcttatgaaccatcagttttgctccatgtaattttccaaataatccccacaatccaaaacacacacacctcttagaagacaactaaggagatatccacaaggcttttgtatcattatttctaaagatgaggagttagagacaacctgggtatctattaccaggaacataggttaaatgtagttgacatcttgactggatcatcaggcagcaacgagaagtaatagacaagtttcacccttaacaacactgaaatattttaactcatacatctcagtagaaaaacagtgagcataatgacatatttcacaggatgatatttacataaaataaacataattgtgaacatacgatatgtataacacattgaatggaaaatatactaaaaatacaaaacaataagcagagagaaatgttcacttctctagccccacaccagcctctccttctcccctggcttctcctagcctagagctgtccatcagcacagggaaggaatattatgtgcaggccccaagcactctgagctcaggaaccagctttttgaggaaggcctggatatgccaggcattcagctcctggcaacctggaagctatggaaaatcatagcacctctttccagggaaaagaagcaccaaacttcagccagtttgttaccaggcaactgagaaagagccctggggtattttctgacaacctgtgaattatttggcctccacccccttaagagaacctaaggaataacagtccatttctaaccttcttctctgcctccttctattagaacctaattcaatcatgcaccaagacaagtcaaagccttggtgggcatatcaatcctgatgtgtgacattttattcacttttttattctgaaagtaagtatcttcttaaattttgcatctatattataaatcaatgtaatatatgtatttatacagaaataaatataactttgttgttataatgcatgactttaaattgtgataaattgagcaggaacatttaaaaccagcaatgggtgcaccactccatggctccttccccactgcagagcccgagagtgaggaaactcaggctctacctccatgtccctgcagggctgagcactgacctgctcattgctgagaactttgagtgaccagagtgggtctgaggaacacagagcagcaggtgccagggagacaggcggtggagctaggccacagtggaggaacatttggtgcccagagcttcctgtgggcaggtccttcccataggggatcctgtcagacagagcagcacctgaggtcagtggctgtgtggtcacaggatgaaagccctccacagcctattggcagcctcccctctgactggagccatgtgggacctatcggcccagctttcacgactcacacagctgctggaaccctgttcacaatggggttccttgatcagcttcactgctgatggccagagtgatatctgtccaggcagttgaaccctgacccgggcaggtgttgcatccacagagaaccaggagccaacaggagctcagagctgggcctgttttctgctggagccaagctaaaatagaacgctcttaacactctggccggccctacagatgacagtggccttctctctggggacataggaaaaggggtaagagatggagtgcacacaacatacccactggcatctatgttgggaacaaacatgaacatccccaagtattaataccaaacaagtagttcattcagtttgatgaagttctgatcagaaagcaaaacaggctaaccacttcatcttcaaggagacattctagtagaaaatgcagacaaataggatgaagcctgcatcttccttcctcactagagaatcagaacagcaggaggaacaggaacaaagctgggtgcccatgtccatggggagcctccggaggccgattctgcttggagctggcaaggatggtgtagtagtccactgggactcccacaccaaaatggatatggctggacaacttaaactgcagaaattaatttttatatttctggtggctggaaattgcaagatcaaagtccaacaaggttcactttctggtaaggaccttcttcctggtttggagatagccaccgtgggtagaaagttgagttaggggcaagagggaggagagagagagagagaaaaggagagctctctggtttctattcttataagaacattaattctattggatcatggtcccatccttttgacctcatttagcctcaattacctcaatcatctcctacagctgcataaggggaatagggccaggcttgcattctcagatcacagagcaaagaggggtttccccacaagacagcacgctggaagctcctcctgggtgctccaggtcacacatgagaccccatttcagccttaggggctccatgttgataagcagacatcatcacccttacaatgcaagtaatatttttagatcatggcaatctctttggtttattgtggggtttgtttgccatctagaggcaggtctttgacatagcaacgttcaggatttttgactttgtgctagtgaaaattaatattttttcttttttttattattatactttaagttttagggtacatgtgcacattgaaaattaattattaaacataaataatgaattaaacttaatacattgattgtttaagaaaaacccaaaggccatcgaagggcttaaaatgggtataaagggataaaaagacagagtccttccaaaggaggactgtctgtcacagatgagtctttttttatcaaatgactttttagcagtaattctcaatggtaaatgacaacttcaggtagactgccacaatataatcacatattcaaaaaaattattaccaggaatcgtgtaaatacattttcagattaaaaacaacaaaaagtgtgagtttttcacaagattcacttggtgaaaaatttcacaaacctgtgctttacacaaaagaacatctatccctggtggaaaactggagttttctttggcctttagaagaaaacagctttcccttcactctgctccacctcatgctgctgaggatggccgtgggggcagagactgtgaggaaggaggaaggctgtgcgctgagggtggtcgtggttcctgcccacctgagtgacctcatggagcagagccaccgacaccaccaaggccacctgcctgcctctacactgccatggcacagacagagaaaccttgtcacattcagtccaccatattttgaagcttctttgtaatacatttgattatgctctgattctctttgtatccctttccgtatttggaatcacttatttttcaccattttgacttgagagtatcgccccttgaggtatcagcaccatgtaggctgtatgtttgtttggtttttaaaggtgtccaaccaccttgagtggtttgggccttttcccctgtctcacatcaaagcagaatcttaggtcactaggtgctgtcaatcacttgatggccaaagatggtgatgacagtggttagttcctgcccttgctacttatgcttgtcttctctccctgcattctgtaataacttttaagctccatgatgaattaattagcattttaaacagtgtattaagtgtcttatgtttcttattttcacagtttcagtctgcttgatttctatataaatattgcaatgtctactaaacccaacagaaatggcgcttcggaattttaattgcacttgccatgaaatccattatcttagagtagaaaatcatctcaaatatactttaaaccttaaatctgaagcaggagcttcttgttctgttgcttcaatcattttgtgtctatcacacaatattgtaatatgtaactgacatagctcatcattgagcttgatagaatattataacactagaacactattttacatggaatctattgaaataataaattttctatgtttttacaactaaaacatatgatccagattcattttctggtaatgatgatatcataagtaaataatacatttttgtaacatttgaaaccttttattatgatgacatagtactaaatttatcatccctaaaatagtacttagaataaatacttttacaattagaatttggttgaggaaaaaaaaacctctcatataattctgcatttttcctgtggcatatttagtaaactctgtgtttttcatctttcagtttatgctgctttttttttttttgacagagtttcgccttgtagcccaggctggagtgcagtggcactatctccagctcactgcaacctccacctcccaggttcaagtgattttcctgcatcggcctcccaactagccaggattacaggtgtgtgccaccacaccctggctaattttgtattttcagtagagaccgggtttcaccatgttggtcaggctggtctcgaactcctgacctcaggtgatccatccacctcggcctcccaaagtgctgggatgacaggcgtgagccactgtacccggccagtgctgcttatttctgaagctcacttttggagttgcaagaactccctcttcactgggaaaaacgtaattgaggcaaatcaaaatcttttggcattaagatcttatatctgccatggatttacaaagtctaagaatagtcagaaatcaaacatttttttctaattattcttttccatactccccttgaggacagcttgtatagaacacgttctcccacatgacactggaaagtgcagtttagtgtgagtagtaaagtgaaatagaaagtaaggaaagtgggaaaataccaaattcgcaataattccaaatattatcaccaagtattaatttgtgtaaaataaaccccaagctggtcatttgccacatgtattccacctgtgttgtcactaaactgcatctatgttctggctgttatgctgattgagtgtactcggcaaacgtgggcaagacaggcagggtgaggatgagcctggcaactgataaagctttgaccatgtgggactgaggtgctgctgagactctcatgggccagagtcctcaacagcaagccctgccactgagttctccaacagcctcctcttctgcagactcagagtccctgctgagctactccccagacaagcagtgcaagtgagcagctgggacaccccagcagggaggtttctgtattggtctgtaccactgtgggaggaagctgtatactttgcatgcagtaataaaccccaacatcctcagcctccacccggctgattttcagtgtgaaatctgtccctgacccgctgccactgaacctatctggcactccagagaaccggttggaaacttcatagatcaggagctgtggaggctggcctggcttctgcaggtaccaatacaaataggtctttccatcactatgcaggaggctctgactagacttgcaggagatggaggccggctgtccaggggtgacggacagagagagtggagtctgggtcatcacaatatctgcactggatcctgaaattatgagagagaagtgcaaggttatgtgaaagcataatgaacaacttttgagatttgccttatggtattgatttatggctaatcttttatttttacaaatttgtattcatatcataaaaacaaactctttaaatgaaccctttattaaataggcacaagagttctttcatttctcaagatattattcagagcactgcttttaggagttttcaaatcatcatcagggcaaaatatgaattcctctccctggagcataggccatattcctttaacacatggttagaataaacacgggaatcagtggggccgccagagctcagcttcccaccccctcctcctccctcatctccttccatccttaccaggtatccagagcattagcagccccaggagctgagcagggagcctcatggtgagaagatgaactgagaagtcctgatcagtcaaggcaaggttagagctgagcttttatctcaggctcacaagggaaggtcctccctaggggacaatatgcaaatcacctggtgggtgcagtggtgtggaaagagccattgggtggggggtgaagggggtagatatgtcttctctgtgagcaatgtgatataaagtgtcccttggaggaaactaataaaacctaattcatcatagaggaggaagaaggacctgaatttgaaagtttcaatcttgggcaagtaacgttttataggatgtcagggcttccaaattcttgtcaactctgagggtgaacccgtgtctccccctggcctgtatgtggcacagccacagccatgacaccacagttcaaaatgagattctctatgtaggaagagcaagaactggatccctggttttaagtctcagggtcagcagtactatggacgacattttcctaggtttttattgaaagatgatcacaggtcaggcatatgaatctaccacacaactcatcgttacaataggaaaacaacttgagtattcttcatttgtcagtgatgtgcttaatattgaatttagctgctcctgaataacggtgcgtacatcaaatcacttcacagagactgccactgtcctgaaaaaaacaacaaaaatcctgggagcaattaaaagaatagtttctagtgctatgtaatcttcagtgatttaatacaacatctgatttacttggtaaagaacacacacccagaaaagcaaaacagagctctaggtgttttgcacacaaagcttgtcctgattatcttccgggaaatgcactggcatatgatgttttaacaaagttggtgaaaaaaattgagtaaaaatgatattgaccttaaaacgttgaacgtcatggcagtaacctaaattgagaatatcaaattgtagtgtggaagtaggattagaataaatgtatcatatttcactatttaaatttttatttattctattctttcatcactttttgtaaatcttatgtgtttcactttttttttttcttgagacagtctctgtctgttactcaggctggagtgtagtggtgcaatctctgctcacagcaacctctgcctcctgggttcaagcagttctcatgtctttggagtagatgggactacaggcattctccaccatgcccaactaatttctgtatttttagtagagacgaggtttccacatgtcggccaggcttgtctcgaactcctggcctcaagcgatccacctgccttggcctctgaaagtgctgggattacaggagtgagccacggtgcctggcattgacttcttttttcttgtgatgctgagcaggtcaaatatggttcttagccttggaaatgtcaaactcctaattcatcataatagttaaaagagtcagaaacatcagatgctgaaaagaaaaataaaagtaaagacacaatctaaaagagaacattaaggtacatcttatcactggtataaacggattagtctgaaaaggtgttaactgaataatcagttccacccactatcctatatagaaacttgcattgtgggaaaacgaataacagtaataaatctgtcaagcttgcttttactattagtcaattcttcaaaatcttagttttacaaagtattctttaaggtgctgaatttcagagagtactgctgtttcctttgaaaattaatgacagagctttaaaaagtttacgattgggattggttgttttatctcataatctcttgtcattacatatctgaaaatgtaaaaccttgtaaaaaattgtttcaatcataaaaaggctctgaaattaccctatactaaaggccttgaaattaccctacattattaaacttagagaataatattcttaattctaaagaggaacccctctctcctgaaggtttaaatagagtacacagaggcttcacaacagcagacaaagctggtcgctccatgctggacacagttaaaaaggtagaagaacagcctctatttgattcaattgtggagcggcctctgtatttctcgaatctggaccatgatcagtcgaatgaggaaggactcatccgggtggggtttattgcatctcacttgccagatgctgttagtttgcagtccataaaattgaaggcaagtgtattatttgtatgacttgagaagacagcctcggaggtggaattgtgtccattatgctggagtcagtgtttgtggggtggatagtgtggtcctgtttatagagagtttgaaaaattgaggttctgatcaaacagaaagagatgtccatagggtggcagtagcacacatgactgttgttgggtgaagctttgacagatttgcccaaaggagtccctcacagcaggagactgtctagaatgaaagatgttggggctgctactcagaaaaggtggagaacaagggaaatcctaaggtaaaggaacactggagaaaggcattctctgtctaggggtagccagacaacagcttaatctgggtctgagatatccagagggcaggagtgatttgcaattttcatctcctggggcttatcttacctactgctaacagatgtgggtgaggtttcctgtgatatgaaaagcaagcattctctgaatggctaaaaatcttctttcgggctgggcgcagtggctcacgcctgtaatcccagcactttgggaggccaaggtgggcagatcatgaggtcaggagatggagaccatcctggctaacatggtgaaaccccatatctactaaatatacaaaaaaattagccaggtgtggtggcaggcgcctgtagtcccagatactcaggaggctgaggcagggtaatcgcttgaacccgggaggcagaggtggcagtgagcagagatcgtgcaactgcactctagcctgggcaacagagcaagactcggtctcaaaaaaaaaaaaataatctttgggctgtttttgaaatgattggattggaaaacttgagtgtggcacaggccatttagaaatagcctgcagtttagaaacacaccacataggggcagtttgcactggccatctttagctcatttctacaacactgtcacacattctgtaaacttttttctgccgactgtacttgtccaaacagggaaactcacactgttctggaggagattgagacatacagaggcctgttctccacctggacctcaatggaggtttttcctgactaaaagtgagagtttgcccctgtgtaagaggcgggcggatcacgaggtcaggagatggagaccatcctggctaacacggtgaaaccctgtctctactacaaatacaaaagattagccaggcgtggtggcgggcgcctgtagtcccagctactctggaggctgaggcaagagaatggcttgaacctgggaggcggagattacagtgagcggagatggcgccaccatactccagactgggcgacagagcgagactccgtctcaaaaaaaaaaaaaaaaaaaaaaaaaaagaccaagtcacctacaaagggagcttcagtctctgacgctgcaggtcctgtgactagattcctggctccagacacctgagattgaagctgtctgcattatctcactaactgaaaattgtcaccactggggcatagattcatggataaatattctggtacacagagagctcagggaatgaaggcttcttgtacgtctatatcttgtgcttctgagaatttctctctctaaaaactggagaaaacagagttgtttacatgtttgacctggaaggcaacatgtaacatgtttctgagtcttcagaccctcttctaacctgccaaatctgaaactgtttctaaacgtttggattatttgtctttccttttgcttaaaaaaaaatggaaaaaagtcctataaaacaacagactgagctgtgagattcagtgctggagttttccttcatgcatgttaatctttctgcagagcccacctcaccaaacatcaatacaaaaagcgaaacaataattccattgcctccctgggccttctgcatcttataagttccctcgaaattctcacccttatagaaagtaggtctctataaaaccactcctcaaaagtaggtttctagaaaatcacaacttgcctggaaggttattaattttttccaccatgtgaacatgaaagttgtctttttgactttatattaaagcttggtttaattgagaggtggagggtggagaccccaagaagattctggggacggaatcgggaatttgagccttttaaactgcagtggaaactgcctgtgatgtaaaaatttgtatgaatataccaagaagacaaataaatttgtttcttactttttaatttagagagcatggttcacctacagaaaaattaaaattataatttgagaattttgacatttattactcctcattttatattaattttaagatcaacaaaatactcatataaattttgaatgcagaaatgttaagaccttcaggaaaaaatcagagacaaaatcaaatcacttaatttataaaatcaacagaaattctcttttagcctcttcctgtcaactcctgttcataaaaatctaaagttcagaataagaaagaggcaggggctgaacaaattacctggtgttcattccttgttataacaacaataatggtaataataacaataactgcacagcctctacatggacacctggaaatggtgactctgccttatggaagcagcagcttcatgtcatagtggtaaatttcacttttactggtcctttcttggccaggagtcaacgatcacccaaagttcacatgtgctatgaagcattaactgtgctcaaatttcagtacttctccaaatttgtttttctaaaatatatcctagcaagaaaagaatgcaagatcagtaataaaataaaattaaataaaataaattttaacctcctagaagcagtcagggcatgaaattataaagtgtaacaaaggactatagatatgaccgtgtcttagagacttactttaccagctcttactcctatttaatgttcttaccctagaaaatgaagaatatcgtcaacccagaaaatgactttttgtattgtgaaatcctagcagtcctaggtagaatttaaagcctaatatgagaatctctgttatccgcttatcccagaaaatctgattgcacaaaaagtgtctatatttagcacattaaaacagaaaacctattgatcctgtggaatactgtagcaaatatgtgcaagtttatgatactcatgaatagacttttaaacttgagcaacatcttttgtttccaggttgatgctaaggtattaaatttcagtaaaagtaatttgtcttgagctcaaactagcttataatatttgtcattacatacagttcagcctattcagaactggtaagaaaatatgacatcatgagaaaactgttattaaatttgccccaatattaatatttgcagagagactgagaggcatgatttgcacaaccgtattcaagatattaaaatgtttaatggaataggcaaatccataaaagaaataaaaactttagaccagggttaatatacctatcgagaatttgacttgtgtagcctactgagttattgacaggactgggtaagagttggtgcactagaagtcaggacatcacagtgtcaacttttaccccttcctcattagaaagccaggccagaaactgccctgacacaaggaaaattatcagaaaattcctggagaactctttgtgactgcctggtcatactctggctatggttgggaggctgacctctcccagctggtattgcactgcagctcatatttctgggtactcagctctatagctgccatcaaatggcattaaatggtttacccaaatcaataaggttatgatagtatgtgcttcataaacttggagagaatcagagttcctgatgataggtatatgtattccgttccattctgtttcatgagagtctttatttaaaaaaatgaaggaagctcacagcggcctttttggaatctagaggcaacagattctacaccgtggaatactggtcatgtcaccatccaggtgacatggaagtcttcccagcctttagtggagacccagggcagaaaagggctctgcagcagctccagcctgcactgtaggcaacagtgtctcttgggcccatgcagatacagatgacttgccaaagccgtcaaccatgtgggtaggattgacactgagagaacactctgccacaacagcagactccatagccattttaaaacattagctaagagagatcatgctttgagccacaagctatttcaaagaaattaaatggatttaaatcatataaaataaagtttcagaagccaagggaaatttattaggaatcaatgacagaaagctatcagaaaaaaatctcaatattttaaaactatgtaacatactactaaacaaagcctgggacaaagatgaaaccaagagatggacatttcaaagcaatctgaagtgaaagaaaacacacatcaaaatttgtgggatgcaagaagacatttaatttataacaccgaatttctagaaatattcatgcattttagcaaataaattttcaaaccgatcccctgagctgccaccctgacatacgagtatgagaagagcaatttgtgctcaaaatattttattcttaaaaatgtgggcatgtgatgagcacatgtctattattgcagcaaggaaatcacgtcagcctggaaataaaaacccacattagcagcttcacaggagaaagtggatgggcagggtaagtaagtgtgcagagaaaattggaagaagataggaaaagtgaaaataggaattgtgtgtaatattaatacaggctatgcatgtgtgagactcctgtgagctttgacttgctcaaaagcaaaaatcatgcagtgcagacaactttcaatcctcagagtgttggtgagagtgaggtcatttggcaaagggaggaaaaagtgccccgaagttcatcagaggcagcaggtgaggtcacgacccacaaggatcccctcccagtgacgtgaacgagcatccctgaagccatgagggcagcagggaacttcatggttgctccagagaggacatggcagccactccctggagagtctgtggggcctgaacaccctaagttgggaggaaggaagaggctctgggaggcttcctgggggccctggccctgttcgcacagaagtagagcccatgcctgtaagtgaggactcatgacctcctcttcaaaggctctccagccatcttcacctgagcccatctgctgtggactccatctctgggcgctgcagttgctggtgctgcactgagaggctgagcctcctagggaggctgcgtttgaggccctcgggctgtgcagggtcctggtgagttttctgctcacaggagaacgtgcagcatctccaggctccaaactggtgcctgtgatgaagaaatgaataaaattttgattgtatgtgtgtccttactttttggtatgtgtaaaaatatactctggagacttgttattaattttgtcttatacaccacttgctataaaccaaatttttactgtatatgttgtctgtctggttaaaactacagatttaattatgcttgtcatggaatacattatctttaatagaaaattatctcgaatgtaacatatttctttaatctaaatctggattactttatcctgttgattgcaacattgttttactttagtcataccacgctatagcacgtaaatcacaggctcattactaattcacaaatattcatagagaactattttaaattgactctatggaaagcatacattttttatatcactattgttagaatgtgggaatcaggtttatgtccaagtactgacgaggtacagtgaaaataatacattaatttattgtttaaaaatgttttactttttttgaccaaatagtaccaacatagtcacttctaaaactttatttgtgtttaaaaaaaaaatgaaaggaatcttcattcccaggtacagcaatgtagatagaagtggaaaggccaaaacaaccactgcaaaaggtacaaaccatttaaaataatagaataccaaagttagaattaaatgactttggaaagtagtggaaggaataaggaatgaatgatgtaaaatgccatagtaaaaagaacctttcattgttgagctgatgctcacctgactttttgtccttctgccatagccgccaagtttgcctgtggaaacaagctctgacttggtgcaggcagaggagctctcctgggaaaggagaatccagctgagccttgggggttgcacagggcagcctctatacgtggcccgtgctttccatgggacacatgttgaggtctgagtcagcaggcagggatggaggtgctgggctacaaggacataaaacttccacagattcagcgtgctcccccaatccccaaggctacacagagcatcccgaatacatgtctgaatcatggacactggtctccatccccactgcgccccctgctggtgtagaccctgctgggccttctgctcagcatgtcagtgcttgtgacatctccagacccaaccagcagtctctagggacagaatgagtttcagatgctctgcttggctgtgtggggttgacaagatatgagtgacatgacctcaggtctccttgcacagggatttcactaagcctttggtgattacagatctaaaacccttcccaaagcattattttcccagaaaattcgcagtgatgcaggctccacccaggaaaccaggtagtggtgccttcaactctgtgattcttcacaagaaacacatcaggcctcctgggtccacatcatgaactgccaactccaccaccatccacatccctacctaccaaaggccaagggtagtttaattgaagctgacctctcctgggtttccttcatgctttcatccctaatgtctgcccaatcttaaattcttaacatttggaaataaaaacattcacatcattctgtacttttccagttttctatggggaaaattatatactctacattttccagtatatgctttttatttttgaaaacaacttctggaatttcaggtactccttttttctatcattaagaggtaactaaggctaactaaacagttttagcattaggatcttgtatcttctatgaatttacaaaaatctatttgatactccaaaatcaagatttttactgactgtcctcagccagcttccgcttaggataactggtatagaatgctgtctctactctattttgggagtgggagaaaaggagaagcaggaagttagaaaactggcaaaataccaacatcaaatattatcaaatgtcctctgaacaatatgccaaaaactgctaaacccaaagatgtatcccacatggatagtcacaatctgtgtcaatggcctggctgctctgctgattacatttaattaacaaatggacacaaggtagggagagttagggtgagctttcattctcctctcccttccatcttgcttgtttactcacagggcacttggacccctcattctcctgctgcttatgacagtcaaggtggtggcaactggcagggcataaaggagtggtgcctgaggtgtgactgggctctcaaagtccagagtcctcagctgtgaattgttccctggttctccagcatcttcctcttacacagattctgagaccctgctgagctgctccccagacaagcaccacatgtgggcagctgggccaccccacagggaggtttttgttcagggctgtaccactgtgggaggccagtgtgtaccttgcatgcagtaataaaccccaacatcctcagcctccaccctgctgattttcagtgtgaaatcagtgcctgacccactgccgctgaatctgtctgggaccccagagtcccagttagaaaccttataaattaggcgccttggagattggcctggcctctgctgaaaccaattcaagtaggtgtttccatcactgtatacgaggctttgactagacctgcaggagatggaggccggctgtccaagggtgacgggcagggagagtggagactgagtcatcacaacatccccactggatcctgaaataaatagaaagaagagcaaggttatgtataaagtttatgtgtaattttcataaattttgatttgttgtttatctcaggctatatatgtatttgttcatatttcaaaaatatacagtttcaaaatggaactcaagggatccaaggctcaaaggggtctccagaagaccccacaccatcccctttctgtgtcagtcttccccagagcacagatccttgtttcttcttgaatcttcctgactctcacagatctgatcatcacatgccccattctggaggacaacatgtgcatgtccaatacaggaaaggaacacacataggagtgtagtgagacccccagagatcactgttgttagaggcagtggggccccagaactcaccgttccatgccattctcctccctcatctcccttctacccttacctgggacccagagcattagcagccccaggagctgagcagggagcctcattgtgagaaggtgaactgaggagtcctgatcagtcaaggcaaggttagagctgagcttttatctcagactcacaaggaaagtcttcaccaagggataatatgcaaatcacctggtgggtgtagtggggtggaaagagccaaggggagggtaggagcctctgttgtgagcaaaatgacttaaatatcttctctgtttggagggaaatgagtaggcatataatctatgctgtctatgtgggagaaatttaagtatttccttctgtcttccctaacagatttcttgtttcatagcactttcccaggcacattttatacttcttgttaataaggccatgtttccacaaatatttactaattcttatgtttttgttcatttttgtttaaaagagttcagatttggccctttcaattttttaaaaatttaaataaaacacacacaaagtaaaagacagaaatgttaaaaagtgcaaccgaataaagttttacatatattctccaccgagattaaactgtagaatactgcagaatctccagattcttccctcatgtacctacctttcaggaaacagctgttccccccatcccaatcaaggaaactggcattctgacatctgtccaaatagattggctttccctacatgaaacctcatataaacggaagtaaacatgttggtttggtctagctctttttttgttcccttagcacttttgaggccttccttcctccctacagattcaagttactgtctgctgtcattttttgtgaatctgaagaacttcctagagaatttgttatacagcatgtctttaagtaattatttctcttcatttttgtttatcaagaaatgtttttactttacttttattttgaatgcatactttcactggatattgaatcctaggttttgttttcttttgtttcccagcatttacatatgtcattccactgttttctagcctcctttggtcatgatgaaaagttagctgatggctttatcactgtatttctgtatatagagagtcattttatttttgtacatttgcgatttcctccttgtcattggttcagcattttaattataatatgtatagttatgtgtatcattgtgtttgtcctgaataagttctttcaatttcttttctctatagatgaatgagtttcattgcttcttgaaagcttttgtcatccctccaaaatttttttggccactttttctgacttctcgtttctgactcattgcatatttctggtcttcttcacattgacttgtaaacctctaaggtcatgattatttttctttagtcgttttctttctttttcagattagatcatttctactaaattgtcttcaggctcattgatgcttctgccaacttaaactcctgttgccctatctagtgaattttccatactgctttttatagttttcatctagaattcctatttgttcctttcccatagtttccctttctctgttgagagttctcattctttgagtaattgtctttatattttcctttttcagtccttgctcatagttttgaatattctttgaagcatttatgtgacaaccacttaaaactcttagcaaaatccagtatttaggaacagtcaagagtcagcttccactgactgatttatctcaatatggtttatgattttctctttcttttcaggaattttaatggaaaaatgccggttgataatatattttttacgtctcacaaataatatataattctgcattctgttttatttttctaagattgttgaatttcctcttaatagcttgactggtcttatgctgcagaatctatcccttactagctgtttggcaattgatatttctgatttttttcattttaagttttagccagaagccctacctgtgtctgcacagtttggtaatcaccagtaacttaggcatttgtgttgctcaaactccttgacctcaataatctactttctgccaatgtatatgtgtgtggcttgaagcgtgcccataaaagacacctccttcacttttattcactgggcccacttgggtctctgtcactcaaatacgcaatttctaagtcacatctgctcattctaagaatgtgtgcagggatgatctctataattctatgactccatggtttccagtaatccattatcaagttttagctggtgtaccagtctcccagggtcatcaccttggacttgcaaaactctgggccttttctgggcatttcctgcagagttcagcaccattagctgaaaacactgaaggatcttgttctactctccatcccagctcaagtcaatcccgtttggcaacaagcttccagttgttgctgccatttcagctggtaaaactacagttctaaaattcttgttgacgaagcttgggtgagaaaaagcagttccaggcaaaaggccatagacttttcctatctgttagtccaaggtgcaccattttgtaagccccccttccattttgtagaccttggtcaaagtgaagcattccacgggggttagaactgtgagaaacatcctgcctaaccacgtgaatacaggaacatccctatcgtcttctgctggacagtgggcccaagaaacattcttatcacaccccgctgggcaaaaggcccaaggaacatccttggcaaaaccgcctgaccacaggaacatgttatcaacgtcctgccgggcagcaagtaataccgtctagacccctcccgcccatacctataagtaccccagcctgtaagcggcagcgggttctggtattaagctagtcccccacctccacagtcttgtgctggacataaaacctgctttgctgtagagccgccaactctctctctgtctttctttaacccttcccttcccttcaaaacctaacactgtccttacccaaagctctcatccttttcaagatacagccatatctccttttattgtgttttgctttactgtgctttatagatactgagatttttaccaattgaaggtttgtggcaactctgcctcaggtaactattttggtgccgtttttccagtggtaggttcttacttcctgtctctatgtcagtattgctcagcaatagttttaaaaaattaaggtatgtacattttttaggcataatactattgtacatttaaccgaatacaagattgtgtcaacataacttttatatgcactggaaaaccaaaaaatgagtgtgactccctttatgataatattcattttattgcagtgattggaaactagaccagcaatatctctgaggtatgcctataaacatgtctcaatttctttgatgtctttggcaatttccagaacagccacagtgacgaggtctggagcgagggtgcacttgcagtgacagtgggtctggggctgggcatgggctagtccacataaaggtggcttactgtctgagttgccagggcagggtgagacctggaggcctgggtctggggcagtgcagagggtaaggttgatgccaaggggctgggaggtagccctgtcacaggagagaaaacaatggctcctcactgcggagtgcgtatagcagcatctccctctctggggagtgtgcgactatggctgcaggtaaccgtccaggcaaaagcaccagtggcccctgtggagcaggctgctgtgatcctcgacaagaaatattaaagggcctccactgggaaagctgaatggtgggggattgcctgggtggctgctgaggttatcagcagcaaaggctgcagggtcctgccacagagcaggctatggggcccacagtggcaccacctctggctgataacaattgcttcccctttctttgttcctagaggtatcagggctctcaggtgtgccatcagcttccagccatcctttgcatgtgcttattcttggctttttactctatcatgttgctgcatgtttgtaattgaactcttcagccctcccagggtattggccttcttggataactgactaattgctgggttttgtgagggctgaagcctggtatctcttactctgctatcttgctaacatcagtccccaggacatcattttggtgatgatattttgaattttgccctgacactattatggaataatacttagacttgatggggtgagaattagagcatttaacatgtaagagggatatgaattgtttgggccacagggttgactgatgccagttatatccttcaagatggctgtcacaaggcctaccattctacaggttcctctaaaagtgtgatctctgggtggggtttccacgatgccatatgcctatctccccccacagttaatcagaattctgaatctcatattctttataatttgactttcctctctgttaatttcttctatatgtattcatcaaataatatttttaatttatttgtttaaaaccctataagaaggaattcatacaaataaaacctaattcatgaatctttgtctttgtgcctagtgctttgtgtgttctctttaagaaatttatttctgcacctgtttatgatatatgtttttatgctctttactaaaagctttattattttgccttcatatttcattttatgattcatttagagttgatatttatataatatagaggtgaaatgtagaggtcaggattcattttgatgtaatatagatatcttattgatccaatacagttcacttattatatatttttctactgatcactgctctggtctgaatgtctgcatctcatccaagattcctgtttaccccatgcaacaggattacaaagtggggcctttgggagctgattattcatgaggattccaccccggtgaatgggatgaacgcccaataaaagtggcttcacacagaatttgtctcttttgcccttccacctccacaacgtgaggacacagccacaagccaccatcttggaagctggagcagccctcatggtacaaaaagattgccagtgccttgaccttggacttcccagccttcagaactgtgagaaagtacatgtctcttgttttaaattacctgaccaagatatttttctctttcagtatgcatcatctatggtaacagtgtttttttcttttttttttttttttttttttgagacggagtctctgtcacccaggctagagtgcagtggtgcgatcttggctcactgcaatctctgcctcccaggttaaagtgattcttctgcctcagcctcctgagtagctgggattacaggcatgtgccaccatgcctggctaatttttgtgcttttagtagagacggggtttcaccacgctggtcagactggtctcgaactcctgacctcgttatctgcccacctcagcctcccaaagtgctgggattacaggcatgagtcactgtgcctggcccgtggtaacacttttatcataaattgggtgattacatatgtgcggatctgtagttacattattaattagtgttatttgtaacagggtttgatattgcctggtgttattccttcaattttgttcttttttttttttttttttttttgagacagtcttgctctgtcacccagactggagttcagtgctatgatcttggctcatttgcaacctctgccccctgggttcaagcgattctcctgtctcagcctcctaagcagctgggactacaggaatgtgcaaccatgcctggctaattttttgtatttttttagtagagtcaaggtttcaccatgttggccagggtggtctaactcctgacctcaagcgatacacttgcctcagcctctcaaagtactgggattataggcgtgagacaccatgcctgccctgttattctttttttgttttgttttgttgttgttttttgtttttgtttttttgagatagattctggctctgttccccaggctggagtgcaatggtgcgatctcagctcactgcaacctccaccacccaggttcaaatgattctcctgcctcagcctcctgagtagctgggattacaggcatgtgccaccacacctgactaattttgtatttttagtagagatggggtttctccatgttggtcaggctagtctcaacctcctgacctcaggtgacctgcccacctcagcctcccaaattactgggattacaggagtgatccaccacgcccagcctgacctgttattcttatgcaagattccaatggctatttttgtcctttttaaatgcatgtgtgatatgtatgtatctatatatatacacacacactctctatatatatattatacacatacatatcactatatatatacatacaccatatatagtgtgtgtgtatatatatatatatatagtgtgtggtatgtgagtacatatatatatatatatatatatatatatatatatatatactatatatatatgaaacatcatttcaatttcacaaaagtcctctgggattttaattgtcactgtattgaattaattaagggagaattatgttactcacaatattaagttttataatgcatgaatgtggtataaacttctatttattgaagtctccattgttttctctcaataactaagcagccaccatagtagcttcccataagtaaacagaaggcttgaggaaaaaacaccagctgtcttgtggaggtttggtttcctgtggaatcactgtggaatacccaccactatgctgataacagtgttaaagtgcaaaatcttcatgctccagcctgctgataatgagactgaagttttccccgaacccactgccactccaccaggctgggacattggtggtcctggtggatgcaccatggatgaggagcctgagagcctgtccaggtttccactgataccctgctaaggagctgctaatagtctacttggctctgtaggtgagggtggctttttcccctagagataaagacagggaggctggagactgtcatcacaagttctctggtggtatctgaaattggaataaaaacagaaatgtcacacatgtacactacatcatacctattgtcttcccagtgcatccaggaccattgatctacattgagctttaatcattgtgccttcccagcaggtgtgccaggtaacaggactcaacaaggttgagaaagtttcactgacatgcagaaccatccgatgtttcctgcacctgggagccagagtaacaagaatcagagcagctgagctgcagcttccatggttccctctgggtcctaactgagctgctctttcacagacctacccccatggattgatatgggctctggacagcagggtggctgggagagacatgcataacagccacagatggcgctgggcttcgaaactgcagagaccacctgcctggttcaaatgattctcctgcctcagccttctgagtagctaggattacaggcacccaccactatgcccggctaatttttgtatttttagtagagacggggtttcaccatgttggccaggctggtcttgaactcctgatctcaggtgatccgcctgcctcggcctcccaaagtgctgggattacaggcctgaaccaccgtgcgcggccaccattgcttcttgaagtagatttcccagcactccttttgcctttctggtttcctaaccattatatcctctggtctttgaaaagttgtaatttagacatggatttcccatattaggaaaaactttctatttgggttacctacaatagcttctcttttgttgtatgaacctggaccagtgctgtaacccagagtcctcataggtaatgactcttctatgaaattaggagaggcattgccatgtctgctgctggggctgaggaggataaaagaaactaagggtgtagagacacttcccttaccgcttctatgaaaactgctcagtgaccttcagagtgtggctgagtctgagaaacactctcagcagatggaggaaacaggagaagcagctggggcagcccaccctcacatatctgcttccttggggagcttattgggtttgtaacactgtgagagggtcacttttatactgttgaccaataataagaagttgcagcaacttcagactggaggatgctaatggtgagaatcaaatctgtcctggatccaatgccacataactgcaatgggacccaggtttgcaaattggatgcatcgtagatcaggagctcagaagctttccctggcttctctttgtatcaggctaaaacatggctaatgccctacctgactttcctggcatgtgatggtgactctcacctagacaggaagacagcgaggatggagactgggtcatctgcatgtcatatctggcacctgagatgggaaacaaaactattaacactattaaccatgttatgagaggactttcctgaatagccaggtagtactgaccacactggctcagtaaattcctagtgttctccttccttgcctgagagtcagagcagcaggagccccaggagctgagcagggaccctcatgtccatgctgtgtcttgactgggactgactcttgcaagtggtatgaccagcctgtgtacaagtcttcaggaagttggctgtgtttttttgaaaatgaaaatttcaacagatgcaagaatgactttatctgcataatattgcacaggcctagtgtcccccaggggtcctaagattgatcaggcctgcatacacttgttagcagagaacaagtttctctctgggggccacagaacagaatctgtctactgtcctgcaaggagattgcttttctgctctgcagaagtaggtcatgacctacttttcttgctagcttcccgtctaagacctggcttgttggagaagcacatctccagaatctgcaataaattttagaagtgtcctgcgtttggtactgatgaatattattgaggccacagagacttcttctttgctctgatcctctagagcccttgatgttgtaaatcatcagcactatcagccagagatgcaatgatgaggtataagaaagatggatggatacatagatggatggatagaaggacagatttatttattaaaaataagaaaaaggaaaatgttaacacaaaatatgtgaaagtagtgtaatgctttgcaaggattgggtaatccttgtacactgggtaaacgacatggcaaatctcttatctcagacatgtgatcatcttcctgtatttctacattttctttcctacttcttacatctaggccaacatcagaaatcttctccctccacttctgaaaagtgtcagctactctctacctctgtgtgccatcatgcattcctatgctagatgtttcctgagctccttggattaatatgtgtgccttacgtcattcttaagctaatatcttccggaaactgagatgttatctagacccagtgctcacatctactcttgaatctactctgttccataaactgtatatctctatattaccaatctcttccagtttttaagagaaagcagttcttaatgactgggtttagggcatttgaccaaagtaggttcagaaagaaaaccatgcaccaaaatgaaggggaaaccaaaatattgcacagagtgtgaaacccacatggcatggaaagggcagttgatgtgcagtagagagggaagaccaccagaggtgttgaagctatagtggagggaggagggtatccccacataggcgcaggatgtggggcaacatcctcccactagcacatatgtcacagctgaagcaggatgagcagggcccttcaaaaggggtaaagccagtggtactagcaaaacggcccatgtagattgagaaggtcacccatgcaggagtcaaagttaacagtgagctggcaaagcatatcagggctaatgcaggttgtgaggcagaagagggaagttgtctaaaaggagcgtgtaggtggcaatgacagcaggagattagtgtcacaaagagatgttgatcccataagtcagtgtagtaaggataattagagccaaggtacccagggagaaatgttagaaatattttaaaagcgcgtactagaataaactctatgactctggattatagctatatcagtgccaattcatggtttatgtagatataggtaaaaagatagatgaatagatgatgatgatagatagacaaatgatagataatagatagctcattttctctagaagcgatgacacatcagtcccactgaacacatttagtgtgtagatcttatttttctgaatgccgatttctactaaaaggaatcagtaatctttggagaaatggctgatgtcaggtctaaaataggggagatggaagatgagcttgtaccatctagtgccagaaactaaaaaagtgctcagagaatgatgggataaaaacagcaggtattcagaggcagtgtgaatgaggctcccattggacaaatcagaggagggttgactatgaaaataaatgatgatggtagcagagtataacccattgaagaaaatatggatccatgtctatatttcgattaggagagggatattcatgaagtatcaagaacatctccacaaattcttatctctttcaaacagaacaacagtgaaggtgcagggagaagcctggcagacacccccttcagcaggagtcagactgaacctcgtcagtcatgtggcagatggaaatcacacacatcccaataggattcagtgagagcacagtatcgcttctggatattcccgcaacagttacactaacagagttcaatcctgaagaaaattcaaacaaatttaaattgacaatctacatggtaactggtgtgtaatcttcaaaagcaatgtgttcataaagtccaaacaaggacactggaactgttctagatggaagaaaactacggaggtacaggccagcaaaggcaacccgtgaatcattttgttacaaaagacattattggaacaattaacaaaagttgaaatacacttgaggattagatggagtgatgcaccagtgatgattccctggttccacagatgtattgggttatgtaggaaaatgtcttgtctgaaggaaatacatagcaaagtcttaaagggtggaactatgaggtcatcaagttactctcaatggtttagggggaaatgtgttactttgtactctacttacaaactttctgtaaatgtgaaattgtttcaatattttaaaaataaaaatggcagctcttaagagcatacccaagctattctaaggtattttgtgatggcactgagccacacctgttacaaccataagacatggaaatttactgtagacgcacaaagataacactgtgctttctcaaaggtgtgtagttcacagacaaattattatctgaagacacaggtctctttagtatccatcaactaaatgggcatcctattcttggtttggggacctacatagtctacccctcacgacaaatgtaacttgtttgttttgttttgtttgagactgggtcctgctctgtcccctacactggagtgcagtggcaagatcacagcttactccaacctcaaccccttgggcttaaacaatcctcttgtctcagcctccccagtagctagaaccacaggcgtgtgccacggcatctggctaattttttcatttcttgtggagatggggtctcactatgttgcctaggttagtctcaaattcctgggctcaagtaatcctccagtctcagcctttcaaatgctggcattataggtgtgagccactgtgcctagacccatgtaactttatttctctcagctcatcagcatgaaagttctgactgaggatgccaaacctgattatcaaaaaaacaaaaatcaaatcaaatacagtttctttcatcaaccaaataggatagctgtgaaactgaagcctgaattaggataaatgtacaaccttaaataccccagaaccactcaggatcaattctcttcaaagtaggatgaagacaagatcacatcacctggggaattgctccgagtttcacggaagacacagaggaagggaggatgaggctggagacaaagctagctctgctgcgaactcatcaaggccagggagccctcaacagcctgctggatcataaaggagccctgtcaacactgacagagcatcttggttggaggtctccaatcttgtatttcaatggagctattgagtgtctcagtaataatgcatcaatcaaagctacatgcacactcaacatgagggacctcttgctctgggccccagaagtgaagggccctcaccaggctctcctcccctccagtctttcacagagagagactgagactgtgctaatatagagccaattttcttctacatcacaccctgatacttggggtcctgaaactaccaattcaaatgttctaaccctaacttccagggacttggccccttctctgggctcgttcctctgagagtagctacgcagtaggcgttccccgctcagacacaaagtgaggccaggtttctgctgctgggaggcgggatggcatgtgaatgtgtgtgaagtgtctgtatatgtgttcaggagaacttgtgtggtgtggaaaaagcaagagatggggtaatggcagtaaagtcccaattgcaaccctaaagcacgacctgctatcctcacactaccaggtgctggtgaagaaccttgaggagcgaaaaatatttaaattcagacgtaggcttccagatattcaacctgtagccaaaagagattagaatggactaggtttacactcctctctggattaactaaaacacaggacacaatacatgaggcaaatgttttcaagaaattggacattagaaattaaggatattgagcccagaagattttaaaccaaaggagatgaaatttggaacgatccatctgagaccctgaggagagttgccagagcattgtgtagtgaaaggaaatccatgaggtgcctgggagtgtccctgaagagaggaaaaagaattggaggtccagaaagacagagaaacagaggagggagttcagagagagcccaggctatccccagatgcctccctcagtattccacagagcactgatgagtacatgcacgtggagaccctacctaaggctgcagaaagactggctgaaggattacaggaagattcctcagtctcctcttttcatgtcatgagacactgcagatgactgagaacccggtggctcccctgagcttatttgtcatgcacttttgatgacatgaaggttattcatgttggccttctctagtagattcacctggaaagcattaaatttagcaggaaaaaagggggcaaccatgccctcaatgtggagtggtcattagtattggttacaaatgtgaactgcactaagcataaagggattcattatgggatattaaatagctcaaaaattgttggaaagccttaacaacaggctccaggcaaaacctctggaacaatctcacaaactgtactgccgattcaggctgcggaggagtccttactgcctgagaccccatattcagactgcctcctgcagagaagacagctgttcctctcactacggcccacagaaggacagcatccctgccagcagctaccagagatctgactcctatcctgcagctctccctgtgttgataatatccctaaattcagtcccgttcacattcatcgtttttcatgactacatatctttttctatctccatccacccttgtggcttgacatcaccaatacacactttcccacacttgaattcctttttcacacattaaaagcaatgtattaacacctaacatattgcaaacgttgtctttacaagtaacatcaggatcacttctacctaaagaatggggacacccaagactgaaccaggaagaagttgaatccctgaatagaccaataacaagttctgaaatcgaggcagtaataaaaagcctatcaactaaaaaaaagcccaggaccagatggatttacagttcaattctaccagaggtacaaagaggagctggtaccactccttctgaaacaattccaaacacttgaaaaggagagactcctgtctaacttattttaagaggccagaatcatcttgataccaaaacctggcagagattaaaaaaaaaaaaaaaaaaaggagaaaaccttcaggccaatatccctaatgaacattgatgcaaaaatcctcaataaaatactggcaaaccatatccagccacacatcaaaaggtttatccaccacgatgaagttggcttcatccccggatgcaaggctggttcaatatacacataattcatcacataaagggaactagagacaaaacccacatgattatctcagtagatggagaaaaggtcttcgataaaattcaacatcacttcatttcaataaactacgtattgaagaaatatacttcaaaataataagagccatttatgacaaacccacagtcaatatcatactgaatggacaaaagctggaagcattccccttgaaaaccattacaagacaaggatacccctctgtcaccactcttattcaacatagtattggaagttctgaccagggcaatcagggaagagaaagaaataaagggtattcgaataggaagagagaaattcaaattatctttgtttgcagatgacatgattctgtatctagaaaatgccattgactcagcccaaaagcttcttaagctgataacttcagcaaagcctctgaatacaaaatcaatgtgcacaattgacaagcatctacacaccaacgacagacaaatagccaaattaagaatgaactcctattcacaattgcaacaaagagaataaaatacctaggataacagctaacgaggaaagtgaaagacctcttcaaggagaattacaaaccactgttcaagaaaatcagagaggacacaaacagatagaaaaacattccatgctggtggataggaagaatcaatatcgcaaaaatggccacactccccaaagcaatttatagattcaatcctattcccaataaactaccatgacattcgtcacagaattagaagaaacaatttggccgggcgtggtggctcacgtctgtagtcccagcactttgggaggccaaggcgggcggatcacgagatcaggagatcgagaccatcctggctaatacggtgaaagcccatctctactaaaaatacaaaaaatgagccaggagtggtggcaggcacctatatttccagctacccgggaggctgaggcaggagaatggcgtgaacccaggaggcggagcttgcagtgggccgagatggcaccactgcactccagcctgggtgacaaggcgagactccgtcaaaaaaaaaaaaaaaaaattaaaaattcatatagaaccaacaaaggttgtgtagccaggacaagcctaagcaaaaagaacaaaactggagacatcatactactcaacttcaaactatgctacaaggatacactaagcaaaacaacatgctaccggtacaaaaacagacacagagaccaacggaacagaatagagaattcagaaataaaaccacacatctacagccatctgatcttcaacaaacctgataaaaagaacaaaaacaaaaacaaaaacaaaaacacaagcaatgagggaagcactccctatttaataaatggtgcagggagaattggctagccatatgcagaaaattgaaactggaccccttccttatgccttatacaaaaatgaaggcaagatggattaaagacttaatataaaaccccaaactattaaaacccaaactacttaaagtataattaaaaaaaaaaaacaaagaaaacccaccaaactacaaaaatctaggcaataccatttaggacatagacacaggaagagattttatgacaaaaatgcctacagcatttgcaacaaagcaaaaattggcaaatgagatctaattaaactaaagagcctctgaacagcaaaagaaactatcatcatagtgaacagacgacctacagaatgggagaaaatttttgcaatttattcatctgacaaagttataatatccagaatttacaagaaatttaaacaaatttacaaaaataaaaataaaaaaaattaaaaggtgggcaaaggacatgaacaggcgcttctcaaaagaagacatacatgcggccaagaaacatgaaaaaagctcaacatcaatgatcatcagggaaatgcaaaccaaaatcacaatgagacaccatatcactccagtcagaatggtgattattaaaaaatgaagaaacaacagatgctgtcgaggttgcagggaaatagaaacacttctaaactgttggtgggaatgtaaattagttcaaccattctggaagacagtgtggcgattactcaaagatttagaactggaaataccatttgactcagcagtcacattactgggtatatacccaaaggaatataaatcattctactataaagatacatgcatgtgtatgttcattgcagcactattcacaatagcaaagacatggaatcaacccatatgcccatcaatgatagaatggataaataaaatgttttatatatacaccatggaatactatgcagccataaaaaggaatgagatcatgtcctttgcagggacgtggttgaaactagaaaccactatcctcagaaaactaacacaggaacaggaaaccagacaccagatgttctcacttagaggtggagctgaacagtgagcacacatggacacaaggaggggaacgacacacactggggcctttcaggggagggtgggtaggagaagagcaccaggaaaaatagctaatggatgctgggcttaatacctaggtgatgggttgataggtgcagcaaatcaccatagcacctgtttaccaatgtaacaaacctgcacatcctgcacatgtatcctggaacataaaataaaatgaatggcaaaatccaaaaaccttcagtccagaatccagcattcctcatgggtcacaaatttaacctaaggtctaaattacaaaggagaccagacaacaacactttataaaactttaaagaaaatggtgactgtaaaaagaaaatttttcaacaaaatgtatgcatgcctcacatgatgttttgatatctgttttattaaaattcttccatcctctgagtactgtctgtaacctagggtctagaagggccaaaatacatttccttggcactgtgataattttgtatatgtgcttgtagcttgtgtgtatgtgagtatatacacacatatgtggtcatacaactttgttaaaacataactgtttatataagtttatgcagaaagcaatgtctaaatatatatgcaaatgtatatatcatatataaaaagataaatgcacatatgcacacatatatgtataaacatatgttttattcctggaatgtcaacctaatgattttcaacaatctgtagtgtatatgtaaagttccattctgattattctgttgagtattgctacatatgtgtatcctcaatactaactattcctgttagatgtttccataaatgagctaagttgtattttatttcttctgatttaagtattatttcttctatgtttttgtttctttatgattttctaagtattcatatttatgcagtcaattttcattaaatgcgtctatatatgtggatgtttaataatgtattagcttttcaacaataatagtttgtaacaaaccactcaaaatgcagaggcttacaatactagtatttattttcatgtttacggatgttcatattaacaataatttagctgatctagacagggctcagctgcgtggttgtgctgtaggtcgctgagcttatctctaatatatggatttttttttaattggggtcaagactgaaggagcagtgatcagccagggcagttaacaacatcctgaggtcaagctacacaagcaaatttaagtcccatcagctgcaacacacgtatacaatatgtgggtttcttcttttgctttagcaattactcaaggttctaaaaccttttctccaattaagtttcaaggtatgtgatcatgtcactgacaaataattaagtatttcaaccttcagcattaaaaaagtaaatttattcttaaattaattaaagttaaatcaaattgagtaaaaaaaattggatgtgttttcaacatgtgactttaatcagattttcttaaattgacatgttggataaaaacaacaaaaatttcttagctgaagtaaacattccctaaaacatagcttcttaaaccttcaatggatcatctgttatcttatgaaaatacagattcccattcaattgatctaaggtggttttgctgttttgaattggtaacatgctcttagtgttgctactgggttctggacaaattttgagtagcaaggtttttatattaaaaaaaagaataagaatgttacatctgtgtgtatacacacacacacacatatatatatacaaacacatataagcaaatgtacacatatatatgtatgaacacattttatttatggaatgtgaacttaatgattttcaataaatctatattatactataaaatcctgttctgattacctatatatatgcatacacacacagacacacacacacatattttatatatataatacatattatatattatgatattatatattgtatatattatatatgtatataatatactattatatattatatattaatataattttattaatatatatattatatatattataatagtatatataacatataatatagtatatatattatatattatatataaaatatttatgtgtgggtgtttgtgtatatataggtgtgtgtctgtgtttgtatgcatatatataggtaatcagattatatatatatgtgtacgtatatatacacacacacatacacatacaggtattcaacaaaggttttttttggtccaatgattgctatattatttagtgcaatttctatttttttttttaatatgcagctttttattcctcaccccccccaccctctccacttctgtctccaatgttcattagaccactctgtatgcctctgtgtacttgtagcttagctctcacttataagtgtggacataaggtatttggttttccattcctgagttacttcactttgaataaccgcctccacctccatgcaagttgccgggaaagatattattaaatttatttttatggctaagtcatatacatatacatatatatatatgagtcaaccatatacatatatatatatgtatatgagtcaaccatacacatatatatataatgtttatatatataatgtatacatataatgtttatatatataatgtatatatataacgtttatatatataatgtatatatataatgtttatatatataatgtatatatataatgtttatatatataatgtatatatataatgtttatatatataatgtatatatataatgtttatatatataatgtatatatataatgtttatatatataatttgtatatataatgtttatatatataatttgtatatataatgtttatatatataatgtgtatatataatgtttatatatataatgtgtatatataatgtttatatatataatgtgtatatatataatgtttatatatataatgtgtatatatataatgtttatatatataatgtgtatatatataatgtttatatatataatgtgtatatatataatgtttatatatatatgtaatggtttttcttcctcaacttttactttaaggtccagggcacatgtgcaggtttgttacataggtagacgtgtgctgtggtggttcgctgcacagatcatcccatcacttcagtattaagcccagcatccattagctattcttcctaatacgctccctctcttcctccttctccctccaccacagacctcagtgtgtcgtttcctcccgtgtccatgtactctcattgttaggctcccacttatatgtgagaacatgcagtgtttggttttctgttcctgccttagtttactgaggataatggcttccagctccatccatgtccctgaaaagggcatgatctcattcctttttatggctgcatagtattccgtggtgcatatgtaccatattttctttatctgttctatcattgatgggcatttgagttgattccatgtctttgctattgtaaatagtgctgcaatgaacatactcatgcatgtatctttatagtagaatgatttatattcctttgggtatatatccagtaatgggactgctgaatcaaatggtatttccagttctaaatctttgaagaatcaccacactgtcttccagaatggttgaagtaatttacattctcattaacagtgtagaagttttcctatttctccacaacctccgcagcatctgtcgttttttgatttttttttttaatctgagaaggaatatcattctgtcacccaggcttgagtgcagtggcatgatctcagctcactgcaacctctgtcttccaggttcaagcgattcttgtgcctcagcccctcaaggaacagggatttcaggcatccaccaccacctccagctaatttttgcatttttagtagagatgagatttcgccatattggccaggctagtcttgaactcctgacctcaagtgatccacttacctcggcttcccaaagggctaggattacaggtgtgagtcacgttgcctaacttattgttttttgactttttaataatcgccattctcactggtgtgagatagtatctcattgtgtttctgatttgcatttcttcaatgattagtaatgttgatctttttttcatatgattattggcctcatgtatgtcctcttttaagtgtctgttcatgtcctttgccaaccttttaatggggttgtttttttttcttgtaaatttgtttaagttccttatagactccggatattagacctttgtcagatgaataaattgcaaaaattttctcccattcttaatgttgtctgttcactctgatgatagtttcttcagctgtgcagaggctttttagtttaattagatcacatttgtcaatttttgcttttgttgcaatgctttgggcattcttgtcatgaaatctctgcccgtgtctatgtcctaaatggtattgcctagattttcttctagggtttttatagtttggggttttacacttaagtcttcaatccatcttgagttcatttttgtgtaaggtgtaaggaaggggtccagtttcaatttttggcatatgactagccagttctcccagcattatctattaaatagggagtactttccccattgcttgtttttgtcagggttgttgaagatcagatggttgtaggtctccagcattatttctgagttccctattctgttccatttgtctgtgtatctttttgtaccagcactatgctattttgattaatgtagccatgtagttctatttatcatatgactaaatatcattttcatgctatgatttcaaacttactcatagtatatggaagtacatccaagtgtattctgaggccatcacttcactgaaaaaatcctgagagtcgagatacatgaccacactacgatgtcagctgtcacttccccatcatcactattattctggaagcacatttgccagaaaccctatgccttctctggtttttggtggagttgcccagtgtggggcctgccctgagattgagaagtaagaagaggaggattcaatactatccatcaacacctgcagcaagacatatggaccgaggtgaggactgcagaagcacctgatgaagtcctctaggcagctgagagcatctgcacccccacccatgggcttctcagaaaggtctgaggaccacatgattggcagttgtaccttctctatcagatgcattctggattccagaagagaattcctcttctctagtatttgcgtctttgactactatacttgcaaacctttaaaaggctgtagtttagattctcacatcttgtatttaaaaaaaatcctacttggaatacctagagtggctcactattgctacatgaattccaactgatgctacaactcagacccctcaggtgtaaccatttcttctcaatgaaatcaggagaggcattgccctgtctatgatactggggattaggacaaggaaagacagctacgatgaagtgggccttcatggcccttttacaaaaactctccagtgaacttcaaagtgtgactgcaatttgagaaacattctcagcaggcgaaggcaccagaaggggcatctgggacagctgagcctcacgcatctgctcccctgggtgatttatgttatgacttgttacactgtgggagggagattatcatactgttgacagtaatatgttgcaatatcttcaggctgcaggctgctgatggtgaaagtaaaatctgtcccagatccacttccactgaaccttgatgggacccctgtttccaaattggatgcatcgtagatcaggagcttaggggctttccctggtttctgctgataccaatttaaatagttgctaatgtcctgactcgcctggcaagtgatggtgactctgtctcctacagatgcagacagggaggatggagactgggtcatctggatgtcacatctggcacctgcgattagaaacataaacacaaatattcatactattagtcatattataggaaggcttccatcaagagccaggctgtactgagcccactggctgagaaaattcatagtgttatccttccttacctgagagccagagcagcaggagccccaggagctgagcagggaccctcatgtccatgctgtgtcctggttgggactgactcctgcacagggtgcgaccagcctattaataagtcttcagggcagggggctgtgctctgcgaacatgcaaatcagcaggggatagggcaggctgggcacagctgcagggctggctcttctcagtaactcagcataggagcaatgtccccagtgtcccaggtcggaccagggcatcacagatttgtccgtaaataagtgtttcttcctggaggctgtttggttacaaagaacttttttgagttaattgtcaaaatttgaaatattcctgaggactagatggagtaatgtattttattcgtgtatggagatggagattattttttaaaaaatacaatatgcacttaattggaagaaagcactttgtgctgtacttacaacacttctgttagcatgaaattattctgtttttagaaaggaaactaaatagaaaatatatcaagattgcaatccctgtctacaggctatgcctttccctttcgctgtactgctgctgacttccaatggccatctatgcccctcattgctctttctgaacctggagaaggcagctctgcctgcatgcatagcagaccacaggggctcgaatggccctctctttgggcagtgttatggtttcactgtgtccttcaaaacccatctgtttttaaatttatctcaaagcaacagaattgggaggtggggcctaatgggaagtgttgaagtcatgagagctctgccctcatgagtggataaatgccactataaacagagcttgtgctgtggaaccgaactggagtccactcactcagctcagtcagatcagatattcacattgagtttgcagcaggagaaagtaaaggtttgtttgtttgtttgtttgtttttttgtagggcatcaggtaaagagaatcaggcagctaagattcaaatcctggcctcactgatggcttgcaggtaagggttttttaaggcaggagtaaatttcaggaaagcagaagttacaggtcaaattgaaaattaatacatggaggtcacatattggttttggcctaaaagggcaggatatcttgaaacaggggcttacagatcaagggtggattacaagatttctaatttacaattggctaaggaagaaaagctttgtttaaacatttgggttcagcagaagagacgaattagctcaggtttatggatatgacttttaccagacccctctgtaagatatttagaacaaagtaccatggtcagagctcagtccccagttctcccttttgtgagatctatgtgctggcagattcatttggagggggtcttgtttcctcaaaaacacctcagagacatatactaaaatgtcaccttcagtttctataggggaacccaccatcttctgagtctagcttatttggccattttaggctgtttttacttccttgcttatcacgttacttacttacgtcttaaggctaggtaggtgcttggaatttcctttgaagagagtcaagattttctattctttccatgcttggggtgtgggggttgcaggctcctgagagtgagtccttgctctttcccatttgtgggagtagggtttctctctctctcttttctgctcttcagtcatgctaggacatggacttccttccttctggaggactcgggagtcatagtgccatcttgaaagtagataaactgattcctaatctgacagttccttgatcttagacttcccatcctccagaagtgtgagagaataattgtctgctctttatcagttacaatttcaggcattctgttataccaagacacagcagactaagagagacactatcagtagatgataacaggagtatgataacataccccagctctctcccctcagatggaatagcccagaggcattgtcccgatatttccacatgggatgaagcttcagtcatcctaagagttaagtggcttttaggggagacttttgccacccatcttctatttcctgctacactttccttcttccctcccagtgtaaataggctgcatgcacatagttccttcttgctggtcagcccagttcaatgtggaacaaatccttcaggaacccttcagccagggtaaaagtctgagagaccaaagccgtagcgcagggcctgggatcctaggtcgactttcctcagttctgtcctcactggtcctgagtggccaggaccctactagtgccaaagagggagggtcatcaaatgtctccagagtctttactcagccagactctgttatagttagaagaaaaagaagcacatgctaaataaataaacataaattatttgtatatgcatatatgtaattgtaacacactttacaaattaaatatatttctatgctatttcagatgtaatttgtattaatatatttgtatatcttatacatatataatacatataatatgcacttttcatgtaaataaatataatatgaattgttgttataaggcatggttttaaactttggtaaattgagcatgaacaagaaaatccagcaatagtgccccaccccatggccactttcccactacagagcccaagggtcagaggctcaggactcacttcatttcctttctgggtcaagccctgactcatagattgctaaggatgctgaggattgctgaggattgctaagattgctaagggtctggggaacacaaagcagcaggtgccgaggaggcagggagtgggcctcggctcctggtagaaggatgttttgtacccagagctcagcatgggcattttgtcccctgggggtccctgtaggacagagcagcacatgtggctcatagaattaggctacatgtggcttataagaaaggcttacaggtgtggtcacaagacaaaagccctccatggctcgttggcagcctcccctctaactggagccatatgggatctctctgcccagcttctatggcacacacagctgctggaactctgttcacaatgaaacatttctcccccatgcaaaaccttctgaatatttgttatttttattgtgtgttattcaaggacgacaacttgttgaccataatatttccaaaaggattcatggagtgaagtcaaaactaggttgtcaacactgtgacaggatgtgagagaaacaaggatcacatccctgaagacaagggcagctcatgtgtgaggcgaggataaattggccttataaattcagagcaggatgtgggagaaaacacattgacattctctactctgtgatgctcatcagatgctcaggaggtgcccatacggaaggtgggaagctagtgggaggagaagggggtttaagatttcagagctgcctcccattctgctccactgagaaggccccagatcttcagcagcactccaggcagagcaggagctggggcgaggtttgtgcaccagtaatgacgggaggtgggggcatgtgcccctgaaggcagcttggatgctgatagtcagaatgacatctgtccaagcccatggcccttaaccagggcaggcatggtgtccaggggatagcaggagctcagagccaggcctgggttccgttggaactgagctaggatgctgttcatactctggtcagccctgctggtgaaagtgaccctctcacttgggacgccgggataggggctggatacagggtccacacgatgttgccactggcatctaagtgggaaacaaacatgaacattcccaaatattaataccaaagaagtagttcattcagtttgattaagtttcaatcagaaagcaaaacaggctgaaaacaagtaaatctttctgcttaatgcaaacgaactgaggatgaagccgcagtcctccctcctcatcagagtcagaacagcagcaggaagaggagcaaaggcgggccccatgtccacgagggcttcctgatactgatcctactcagagagggtaggtagggtggagtgtttgcagggattgtgacaccaaaatggatgtgactggatggcttaaaccacagaaatgttatttctaacagtttaggagcctagaaaggcaaagctcaaggtccagaaaggttttcttgctggtgaggactctctttttaatttgcagatgttaccttttggccatgtccccacatgaccatccctcagggcacgcagggagggtaggggagggagaaagctctatagtgtctctctttataaggacagtaatcccgtggtgtcaggatcctgccctgatcacctctttaaccctagttacctcctagcaggctctctctccatctgcagccatattggaggtaagagattccaaataggaatttgtgaaacatagttccttccgtaagaagagggctttggggacacagccaaggcagtagggaggggcaagatgaggcttccggtctcagagcacaggggattttcccatcactaagcacactggcagctcctcccaggcgaaccatgtcagacaggagaccccagtcccgccttagggcctccctgtccataaggggacatgatcacttttacttcctcattacttctaagatcagacgtctatcttttgtttattacggtgtttgtctgccatctattggccagtttctaacatagcatcttacaggatgttagatactagggtccagtgagcgttgactatggatgaaatcttttcatgggtattcatggagttgatcttatgacatccatcactaggacagattttgtagaaaacacgaaatggcccctcccctcaataaaccagtcatctagttgaggacaaacggtatgcaggaaaaatatttgtcacaaaacaattagggtggctagattctgggatccatgtgacatgccaaagatgtggttttggaaaaaagagagggctgtaaaggaccctgtagggcataatggcagggactggggtgagaagctgacggcccctggtttggatctgtcaacccagcctcattcctcccatcccagaaacacttccagagcagctctgagaaccacagtagctttccgagctgaggaagcatccggggacacctgatcttctaaaagaacaactgctgaggtttgtgctctcagctatagcactgcgagtaatcagatgttatcatttacatctgtgctaagcaaagtcattttctaagatgatgaaaatgtctgtatgtatgaagtgcaataggctagtcattagtcctttgtggctgctgagtacatgaaatgtacctgatgtaactgtgaagctacttttctaattttaagtatttctaattgacacatctgtggctatcactgctagtgtttcccacgtggaacagcacagttgtagacagtaataaccagtaatgtcactgggacacccaagcttctaactgttaagcaaaggtgtgtcccaggaccactgtaccaagctggggtggaccatggccaaggtagacagagcacatgggtggatctcaggaaccttccctggatgcttccaggctggtgatggaaactgtccctcttggagacactgattgggaagctggagactggggcccacatagttgcctgtagaatctgaggtggaaacaaaacacagatcttccccagttaatgatgtccctctccataggcttcccagcagagtcctgctggctgatcaagtgggaggtgaatgctgggctccctgaacaatggcctcaatctgagccattgtcctatgggacatatgaactctgtcatgtggagcccccttagctgaaaccagggaactagaacccagagggccagagccccatgtccagtgtctagtgctgcccctgcctatggtgatcccaactcaaagacagagactgacccagtgataagggcttgagtggcagggaagggctctggggagcctgcaaactgtcaacaaaggaaagacctgggcttccaacttctgaaccagggaacattctatgccatgggagtgacccagaccaaggtgtatgatgtaagatattacagtaagttttatctttacgggaataaaaatcagagaaggcatctgattagtttagcacttgctgactttttcagtacacactggtccctgcccttcccataatgatcccgtggtctttgctgtttttgtggtcacctggctgcctcctcaccactcagatgaatcttcagtatgaccctggggccttccctgatcagcacaaatatatggcctcagcctccagataccacagaccattcctgctttttacacaatttgtcaactacagaaattattctacgcacttttattgtgtggttattcttccttcatggctctttcccctactgaattgggacccaaaattgtcttatttactcacgtgcacctaaccttcactcggtggcctttacttgttcctgaaaatgctgccattaagtgaaaatttattaaatgaaaagctatgtttgttctactctattggaaaaaaaaagagtgagccactgtgcccagcggcacctgtgtctttaaaggcatccatgcaggtgagtctgtctgaaggccttgcagtaaaattgattcaaaacctaactctgtaaataagtctgagaaaaatacagacattggagtcaccatcttgacaacgagttacttttcagaatttcaaaatttccaaatagaggcacagttgctaaaactgagcagccatcatagctgcagcccataaagctgctggttttagaaaaaaaaaatcaatggttttgtgaaagtttttgtttcatgttgaattactgtgggacacccactgctgtactgatgagggtaataaaattgtgacatcttcagggtctaggctgttgatggttggggtaaagtctgcctcaggcccaccaccactgaaccgggctgggatgctggtagccttggtagatgccctataaataaggagcctgggaaccagaacaggtttctactggtcccaggctgaatagttgtcaatgatctgactggcctttcaggtgagggtggctccttcccctggggacaaacacagggtgattggggaccatgtcagcacaacttctccagtggtatctgagattggaataaaacaggaaagtcaattgtgcaatctagatcaaatccactgtcttcccagtacagctgggatcattgatgtacattgaatattaattattgttcttgctgagcaggtcacaggacccaataacattgacagagtttcactggcatgcagaatcatcccgtgttcccctcacctgggagccagagtaccagaaaggagaggagctgagctggaacttccatggttccctctgggtcctaaccgagcagctcttcccgagagctctgacccaggcattgatatgggctctggacagcagagtggctggaaggatatgcaaagtagttggagtgggtgctgggcttccagctgcagagaccccctgcctcctcctctctgcactcagcagcccctgcccaggtggtcaggccagaaaagtccattggctcagcctgatggtagaacttcttccctgtggtcacagactatagcccctgtttcttcccgtctcactagtcacctagacccagccagatggtatttagtacaaacctgttgggaataaaatagaagcctgtggttcttttcctctccttatttctccaaagaaccgagtcatctccattggtgcatgaatgtacctggctgaaaactagttcatcagaagttcatcttccacacacacttttcctttgcagcttagccatctttcctatgagccctgaagcctcctcattctttgtaaaaactattaaagggcaacacgcaattaggcccagcactgtgggtgtgatgatcatcacggctgcacagatgagcaggccccgggctcagacccttcagtgtgtgtaattccattccctgcaaacagacgacaatgctgtccagcaggccaggaacaattccttgggtgatgccctactttctatgccaccccatcctgcacaacacatccattcaatcagactcaggcctttctcactttaataattttggaaacctctgctcatgtttctgatctaaacaataattcaatttggggtttccttgtgttccttaaaattgtgagcatttggtggtaagtgacagttcactggacaggctgagaagctctttgggttacattccatctgagttcattaatagacattgcagaaatttgttttctctcttctctaagtactcacataatatattcaattttgcatcttgcctcaccaaacctaaatatttattatctgactcctgagataatctgataatactgtcttttaactaaagagtcaataaatttactatagttgtgattaatatgtgttattatatatcatattctatataaaatttgataaattagaatacaataattattatatgctcttgggaaatactaccaaattataactcgagacaaagtacaaaaacaaagctctgagaattatgatttttattttattttctgaaggctgaggatgaaacaggaataaaagaaaagagaacgttgtcaataaaacaagctgcttaatccactacttagttcaaccattgtggaagacagtgtggcaattcctcaaggatctagaactagaaataccatttgacccagccatcccattactgggcatatacccaaaggattataaatcatgctgctataaagacacatgcacacatatgtttattgtggcactattcacaatagcaaagacttggacccaacccaaatgtccatcaatgatagactggattaagaaaatgtggcacatatacaccatggaatactatgcagtcataaaaaaggatgagtttatgtcctttgtagcgacatggatgaagctggaaaccaccattctgagcaaactatcacaaggacagaaaactaaagaccacatgttctcattcataggtgggaatagaacaatgagaacacttggacacagggtggggaacatcacacactggggtctgtcgtgggggcgggggagggaggagggatagcattaggagatatacctaatgtaaatgacgagttaacgggtgcagcacacaacatggcgcatgtatacaaatgtaacaaacctgcacgttgtgcacatgtaccctagaacttaaagtataattaaaaaaaaaaaaaagacagatggaagaagtgggtgggagctgaggccaggggaggggcagatgagccaacacttgatttttttgtcccaaattgtgaagacagttagagattaaccctgaattagggtttatcccacctactgagtcaagatatgactaaaaaatgattttcatatgacaccttgcaaaacatttcaaaatatcccataaatttaattgagaaaaatacaaacaaaattataaaatacagctatttgtatactttggcctattttgtcacctcactcagcccacagcaaatatacttccttggtgagtgcaaagagtaaaatgagaggccaaggtggaccaccgggggccagacaaaccctccatgagggctgaggaccacagatccccgaggacaatcagacatccagagggagggctgaggaccacaggcccctgaagacaatcacaggtctggagggtcttagcccatgactttcctctgtagagacagattctcccagatggttgagggctgtctgtggctgtgtccttccttccgcatgataatgggggcagagcaggtctctaagcaaaccctgagcaaggccttcccctgtgtgctgctctgacctggccataggtggaactggatttacttaaggaagtgatttttgatcatgaggaaaggagagagaatggggagaaagagagagataaattgtgtatgtatgcacagaaagattggatactttaataagttagttccttgatacctgtgagtgttacctaaattgagcaaaaagacttcacagatgtcaattaataatattaagatggggagactatctggattaaccataatggctctaaatgcaatcacaaatgtccttgtaagagaggatgtgagaagtttaacacagacagaagagaaggcagtgtgaccacagagaaagagacgggagtgatgtgaccgcagccaaggaaagctgcagccaccagaagctgaaagaggcaagaacagagaggcaaatgccattctctccctgtgtgtgtttcctgtagctcctctatcaaatctccacatccttgctggcttcaaacagcatcagtttattcttttacagttctggaagggagaaatctcacacaggtctcactgggataaatgaagctctcactgggctaaaagtaagcttccctatggatgctgggggaaagaactttttctctggccttttccagcttttagaagctgctgtctttccaggcccctggcctttctcttacatcactcagcgtctttcttccttgccaaatctcctccccaaatctgatcctcctgcctcagttttgtaaggacactggtgattacatgtgacccatctagataatcttctcatctcaagatctttagcttaatcacatctgccaagtttcttttgccatataaggcaacattcataggttccacagattaggcacaaacatcttttttttttttttttttttttttttttgagaagagatggggagtgctttactcacactaccaatcattcttattggccccaaactgtccttctctaaacaagaatccaaaatcacatagctggaagaaggatagaatgtgggcaaccaacatctttataaagcaagagagctggagagatctgagtcagggtcctctggtctggggtttccctgggctggaggattctgctgctgctgctgctgctgctgctccaatgtggacctcacatgtgtagctatttgttagagactattctgattttgggacccagaagaaaagaattgctacttaattgcaatctaagagagattggtaaaggaaaattaaatgtttccctaactttctgaatttttctacccgtaaaaaaagaaatccctagaatttagataaagatacctctacacatgagaatttgcctattgtcttaaggtgggtcttacaatgacaagaattcccatgctgacaacatatttacaaagcacagaaaaccctgggagagaagggggaaagtgaggcagggaagacatggccagtgaaaagctcatcaataagcagctgctcatgaggaccatgaggaccactaaagctcatgccaatgtaaaaacacaagaacctctgggctattctacctgagagatgagggagctgtggtatgtatacacctcctttagtcaccacagattgagggctgtcctaggggatgctcattccaggctctgaggtctaccatgcatgaagtcagaggtgccttctgtagtttcagggagagcagcgaggggcagatatcaccatgagaagtcagcagaaatgcagaaaagaattaggacaactactgctacatccactcaaaaaagatgtgtatgtgaaatctggagggtccatgtgggccacatctctctggaatgcaagaatgtgccctagaaattcaggctgcatgacaggcagcagggattctgtgcccacactgcaccaccattgcttggctacccatagtcaagcatgcagttatactccccgtagtccccaggctccagggcattgatagtgaaggcatagctggttccagttctgctgccactatactgggctgggatgcctaggaccaaggtagtgacatgagatgtaaggggttcaagtctttgtccaagttttttactgattcaagatatttctccatgtacattgttgctggcttagcaggagacaaaaactctctttcctgaatgtactgacaagcaagcagtctcctgtgttgggatgatttccccactcactgcaaagagtaaaagaagaaagtggcattgatggtgaacagcaggaatatgcacccagttttagctgccctcactgaggagagagggttcactcacttagcctttccccaggtactccccctcaactgctctccaaaaagccaggccccaggggagctgcttctgagccaccaggaacatgctggtgaggagtgctcagagcctgggtagcgcttgaggcatcagactttatagagacttaggttcagggaaaggcataaggcaggtgcacactaaaaagaggcaccgagggaaggacttactagacctatgcagttgctgggttttgacctaagactggggccagtacgcttgtatggaaatgagcaatatttagtggaaaactttcctcttttgacaatgaccagaaggaaaatgatgcctctacctggagggaaaggcaagaagaagcacatctcttgtgatacttaagttcatggtcagcctagaatcagacaaggcattagttcaacatgcagaggagactgactgtcaggaagttggggaatccttgacattaggaaggatgttagtaaaattggtataaacttcagtaattactgttttttccttcaggccatggactctggtgtctcacttttgaggctaccctcatacttcttgtgatgaagcttgcttcatgtagactggttcagggcctgacagccattgctttgagggttatgtggagccatcactgaaggtgaatctcaacttgaatgacagatggtggtggccactgatgagatggggcttcctatctaagaatcaactcaggtttcttggctctttgataaatggttcccatgcttggatcttaaggtggaggccacaggtctgagttctaagtcttttctttccacaccaacagcctttcccaggaatcaccctggcctcctccatgctgggaatctagacccaaccctcctgctaccttccccagcatccaacagtaactgtctggaagcttttatttgtaaaccctccaaatgcaacctctgccggcaacatggctggagcagtcagcatcctcccatcaaaaaacactgagaaggaggggaaacctgcaaacaccacggtggtgtggaggagatgcatgtaatccttagattttatgtgttttcaaacttttttgtctgtttcttaaccatggttctattttcacaatcttgcagagggaagaattgaagataagaagggttcttttatatttagaatatgaaaatagaaatgacgacagcaggagaatggaatttataaactcttcgaagcggtttgggtttctctagccagggacacagcaggaccaagatgccaggagaggatatcacttattttggttcctgcccttcatgcttcagactcccacaaatgcacacatatgataatgcctgtcttcttctaaagagcaggtctaaggcccagccgtggtctttcactgagtatcttttctgtctaaatgaaaataattttggaagtagtggaaacaaatgatagcaatggcttaagcaaagaggtccaaaggttggagcttttcgagttggtgaagcatcttggcaacagcagaaaggccccaggttctttctctatttctactttgcaccccaccacattggctttgcagacgtaggctcactgcctcatggtcttaagatggctgcagcggctctaagaatcagttcctctcatcatgattactggaaagaatgcaggccaaaattcttcaccaccttcttctttttttttttttttgagatggagtctcactctgtcgcccaggctggagtgcagtggcacaatctcggctcactgcaagctccgcctcccgagttcacgccattctcctgcctcagcctcctgagtagctgggactacaggcgcccgccacctcgcccggctaattttttgtattttaagtagagacggggtttcaccgtgttagccaggatggtctcgatctcctgacctcgtgatccacccgcctcagcctcccaaagtgctgggattacaagcataagtcaccgcgcccggccccaccttcttctttttataagggatgaaaattcttcccagaatctctgctcatccctcactccctgacatcttattgtggaaccaaactcatgtccccctaatttctgttcctgtcctgggctgagagaaactttctgtcctccccatgcacagcaggacagagttggtgcccaagaaaccaaaggaggaagatggctgctaggcaggaggccaaagcctcgacacatttaaatttcaccttgtgtctaagccaacctggatgaagcagaaagatcccaacattctctgaatctggtggggttggaacaagccaggccttgaggatgacaatgaagtcaaatttctaattttccacatgacaatgttagcttcagcagttgaggaaatgtagcctgggaatttaaggccgggacatacttccaagtactggaataaatgagggagagatctgcaatagggacatgggggagcagtggctatggaagaaggaggaaagctgtgtgctaaggttggtggtgccacctgcccacctgagtgcagccctccctgtgctggttgcatccccatttcagtctcatgcagacccctctgtttacatgactccaggtgctatttctgctcccatccaccctgtggctttctgtcatgagtacatatcttcttacacttgaaccctctggtattcatgatatcaacagcaatgtgataacacctaacagaatgcagacattccctttgcatatagcagcatgctcacctctacccaaaaggtgaaaaaactcaaatctgttcagtccaacaccatctaggaaaaactgaccttccctcatgagtcacaagtcaatctggatatcatttaatctgtggtataaattatataggtgaccaaaacagcactttgtattaaaagaattttaataaagggacagttgagaaaaaaatatttaacatatgtaaatgtgtgcgtgactcattcagatttcatgagttggttttctctgtattctttttatcccctggcctccagcacgatctttatggtcgtttctggtgaggctaaccttcatgtctctggcattcagggtcccagatgtgactaaggctctgcacatgagatatgcccctgcagagtggttttcagaagttaataagggaaggggagatgccttccagaggggctcattctcctggtctgggtcctggccaggcagcactgtcctgtgggcacagcatcctgcctcacaagtttcctgtcacaatcagaggatttttctgcatagaaacgcaggaagaaacagggaagtgaaatgaatgcctgagcccactcctctgctctttccatctggcttagttcacctaatccatgacaataaacgcgagtttgcttcaccagccataatggcttctcttgtatctgactgcttcgatgacagaagaaggaagaaggaatgagtggactggctcctgtacttctctactatgaagctgacctagaggctgtagctggtgttcacatctcctaagttcactgtgcgtttcatctcccctctgctgcactagtgtctaagtacatgtgatgcttcagctgtgttacttaaagcttcactctggtgtctgtagaagtttctcttcacttttaccagtggaaatggtggtaaatggaaacattcccagctgggcacaatggctcatgcctgtaatcccagcactttgggaagccaagccaggtggatcacctgaggtcaggagtttgaggccagcctgggcaacatggtaaaaccctgtctctactaaaaatacaaaaaaaaaaaaaattagccagacgtggtggcaggtgcctgtaaccctaatcccagctactcaggaggctgaggcaggagaattgcttgaacccgggaggtggaggtttcagtgagctgagatcgtgccattgcactccagtctggacaacaaatgtgaaactctgtctaaaaaaaaaaaaaaaaaaaatcctgaagttccaaatgtgaaactctgtctaaaaaaaaaaaaaaaaaaaaaaaaatcctgaagttcctctgggttccacatattctctacttcctctctaaaatatgtagaaggaaacctatacctatgactccagcccacaccataagaccctttattgacagtttatcttacatcataatgagaactaaatggccgcatgttcattgtttcttccaatttattaatgatttatcatgctaacccattggatcaagaactgtcaaccagaaaaccccggacctgagtgaacagaaagagaacttttcaatctgctctgtaggcataataaatagtgatgggctcaccccccatgtctcagataccactattctcttgatgggagtaacaataccatacaccttggtgttttggggcctccgccacatctggcaagacagtgatttgacattacaagggtttgtgtgctcacttcacctgcctagtaatggggtttctcctgtctgtagggatagctgcctctgtacacatgacagcatcatgaacctactttgccttactttttttttgctataataaagttactttttccaatgataaattatgtaagggtttcttgacttgaaagcacttgaaaaactttcaagtaattattctagcagaaacatggctgataagaaaggcaaatgtacatataggaaaataaccacccccaccccaatgtgttgggttaggtccaatgtactcacctgataccagctgttagtctgatctcagatgtgtagtacaatgttagggtttcaggaagggtcatggtttttggcaagtcagatactcagatgtgccattagccttgtgagcctcattaaatgaaattcagatgcataaatctccatggcttaagttcatgagactccctgggaaaggtgactgactgaagtccatgtgttggatcaccttaattattaagagttccctgctaggcaatggcatttagatgagtattcacttgggtagcatttatttttgatcttggcccattttgaaagatccagtcacagctcttctaaaccaattttgtccttaagttttgtttcttctgagacctaatgacctgtgcaaattaataatcaatgtcattgcattaccagcctctctttgcaaagtagccaatgatatacccttgtagttaacccactattgtgatttctagtcttccagggcatccttgatgatggcaggggtgtggctttggtccagcacccaatttagaactctgcccagcaggcatcattgtgaaattttaacattttgcctaattttaacattaggcaaaattacctttcttcatatcctttacccctccactaaaagatattttcaggtgcacatacccatttggtgagtgttagaaataaagattacaaaggaaatccctgtagccagagcaggtaacatatatagtcctggacatcagtttttttcatgggagtaactggaattatcttaacagatttaatttatacaataatttcatacgtatgcatgtgttgcttatatatatatatatatataaacatatttaaataatcttatctacacatgaatatgtgtacatagtatttatagctaacaagttatcaaataaatatatatggattaatatgtatgttatatacactcaaatatgtgcattttccataaatgacacaaattttactgtttttatagatatatgatgcaatatatttgatacagtgacaacatttttaagttttatcttagtatctttaaaaacagatcaataaatatttatatttttgcatcagagaaccccatctctagtatctgcttcatgaataacatatgccaggttttcgaaggctatagtttagattctaattcactcagttaaaacaattcctgcttggaatgtgtggcttccattttactgtaagaatttcaattaccccataacacagactcctcaggtagactaatctcctttctttactaaattcgaagagacattgccatgagaggaaagagacttagggtggagagacaccttcatggccccctcttccgtaatctcccaataaccctcaaaactcaggctgagtctgagaagtgttgtcaccagatggctgcacaaagaagagcaggtggggcagcccagcgtcacatgtctgctttcctggggggggtttgttatggtttgtaacactgtgatagggtaatttttatactgttgacagtaataagttgcaacatctttaggctgcaggattctgatggtgagagtaaaatctgtcccagatccactgccaccgaaccgcgaaggagccccagattgcaaactggatgcagcatagatcaggcccttaggggccttccctggtttctgctgataccagtctaaattactaccaatgctctgactcgcccggcaagtgatggtgacgctgtctccttacagatgcagacagtgtggatggagactgggtgactggatgtcacttctggtccctgaaattgcaaacagaaaaacaaatatccacacaattaatcatgttataagaagacttccctgaatggccaggcagtacctagcacactggctgagtaagaggctagtaatttcttttcttaactggaaaccaggatggcagaagtcccgggagctgaatgagggtcttcatgtccatgctgtgtccagacaaaaactgactcctgcacggggtgtgaccagccaattaataagtcttcaggaagggagctgtgctctgggacatgcaaatcagcagaggatggggaaggctgggcacagctgcaaggctggctcatctcagtaactcagcacaggggcagtgtccccagggtcccagatcagagcagggtagcatcaacttacctgcagataatacatttctctttggtggccatactattacaaaacgtatttttgggacaatttccaaaattttaaacgaacctaaggactacattgagtaatgcattttatagttgtattggcagtatgtaggagactatccttgtttgcagggaatgcataataaaatcttagaaagtagagctcttgggtcttcaagttactggcaaatgtatttggtgagtgtaaaaatattttgtgttgtgttaacaatatttctgtcagtgaggaattgtcttttttaaaatgaaaataagactttatcagaagcatttttaacaatattcaaaaatagtttgtcataactttaagccattgttgttactggtataaggacaaggaattgactgcagtttcacaaagataataccatgatttctcatgcatgtaccacgcacagaccctccattttccagagctatcggtcactttaatacccaaggattaaatggatagcaccttattcttgccttggggagaatattctaccaccttttctgtcactgtgtaatatttcttacagatcatcgcataaagggctggctagtgatgccagatctgattagttcaacaagattctctgtttcttcattgaactataggagccttgattaggataaacttgaaaccctgtatcaatccagactcttataatcaaatgtgtccaaagtaggaagacaaagatcatatcccctgggtaatgctccaagctgtgctccctaccagcatgttcctagtgtctcaggtgcagctcccccgaagcctggctttctgaagggcaggtgaaggggaggacctggggaaagacaaagtcagtgaactctctcttctggtgagggtggctgctgctcggtacatgcccttgccttgaaccatcaatgtcatttgcttcttttactcttttgcagtgagtggggacatcaccctgacccagatgtcagcctcactgtctcacagccaggacacagggtctccatccctggccaagtcattgctgatgtatacagagatatatctgaaaatggataaaacttggaaacaaatttgaacctctgtacctcatacctctgcctatgctgagggcatcccaacctgattcagcagcaggggaattggaaccaactacatcagcatcagtgggctggagcccgggtactccaggcagtattactcattcatgatcacgcatggtcccaccacagtggtgcagtctgtgcacaaaccttctgctgcttttccgggggcttggatttcaagagaactggccagtaaacagcctactaatatccaggttcaagacatagggctctagattgaaatacacatcttttttttctgaatgtagccgtctctcttgctacccttggcctttccccttcactgtacttctgctgactccatggtcatgctgctgtctctgagctgggcagactccatggtcatgctgctgctctctctgagatgggcagactccatggtcatgctgctgctctctctgagctggggaaggcagctctgcctgcatgcatgccagaccacagtgtctggaatagcatcccctaggacagccctcaatcggtaaggacaggggaggtgtatacatacatgtggccatgtggaaggaacatatataagttctgacagacctgggttccaatctcagtccctacttctgctgaccatgtgactttgggaaatcacccctgcactctgatgggcagttttcttacctgtaaaatgaagtactgtggatatcaagcagtgtcttgagggcttcaccagatcatgacccatgaagagagaaagagagagagagagagtacccggtgtccatttcatgcatccttgactgtcttagaatgaagacgttatgtaagatattactagtcagatgtcactttcaactaaaaattatcaatatttattctaactaatagatctctctctctctatacagtgaagtttcacgtaaatgttttcccaccatatcctctcccatcaatctatttatgtgtagcagtagaaagttgaacaagaagactgaaaaccaccagagcacgtttcatctgcactttccctgcacttcattcttattagtgtccttgggctgctgtaacacagttccaaaaatctgatggcttaaaacagtttactctctcatacttttgtaggccagaaatctagaatcagtatctctgggccaagatcatggccttggcggccaggctccttcagaggctccaggagggagtctattcttgcctcccccagctcctaatggctgcatctttccttgactgtggccatacccctccagtctttgtctctgtggccacattgccttctcttctgtctgtgttaaatctcaatctatctcactcttaggaggatacttgtgattgcatttagggtccacttggtcaatccaggataatctccctgtttctagattcttaatttatacctgcaaaggtctttttcccataccagttacattaattggctccatggaaaagaacctgataatgtgggggtgatactcagtgctaaaccattacaggacccagtttcagtgtcggtactgtacacacgttacattctctctctatgtctttcgctcactctctcccccttcttccctccctttcttatgatcacaaatcattccacttccctaagtgtatccactgccacctaggttcagagttcagagaggaacacacaggaaggtcttgctcgggtttgcatagagatctgcccagtccccgctatcatgtacaagaaaagacatagccacagacagccctcagccatctgggaagaagctgtctctacagaggacagtcatgagctatgactctctcgacctcttattgtcttcagaggcttttggccctcatggagggtgtgggtggcccctgactataggatttggtcttcatggagggtgtaggtggcccctggctacaggattcaccaggactttcatcagaatatctgattcacagaaggcagtcagtgatagggccacacagagggactctgcagggccagctgcacagagcactctggaacagcctgcctcctcatatttcttcctgaacacacatatttggatctcctaatactattttgctagtccattacttgctctgaaggtaataggtaggattaactaagacagaatttttaatagttacaaatcagaagaaaaaaagtaattttttaaattgctaagctgataaagaagaagataacatgacggcaaaaaacaaaaactctagactgagggctttgggtaagagcttgagactctcagtagtggagcacctgggccatcgcctttcagaagagagggacaatcaggaaagaaagcgtgcagtagaggcaaaaatcttgcttactcagacaaagcctcagaagaaaggagacaccttcttcctgagcaccagcaatcagagaaattctcaataaaaataaatcataatgaaaaataaataaataataatgaaaaaatcgagaatagttataagcgctgcatgcactgctcattgcaccaagtgccttgtaatgaacgaagtgcagacaataatcatagaccccaaatgtgtcccaaacctgaccactcccccgacttctaccccaccacttcaccccaatgcaaacctccattatcttccacctgcaagataatccctcaaatattacccaacttcttctttgctccttgttccttgataagtggtccccactctcagggtcctaaggctgtggccacaggtctgagttctaaggtctttcttctcacacccacagcctttctcactctggcctcctccattttgagaatccagacccaatgtcctgccaccctccctggaatcaggcactaattgccagtagcttttctttgtaaaccctccaaatgcaacctctaacaggaacctggctggagcagtcagcatcttcctgttacgggcagttagacaggcatgagatgggcaggagaggtctctttccccacccactaggaatgtggggtgatggttcagcaatgatcacattgcctctctaaaagtgataagttggcagctggcactagagggaggccatttcctgatggtccacaccttttgcactaaggtgttaattgaatgcaagcaccagggaaatgcaacttcccaggcatgttaaaataaataatacaataaatataaatacaaaaataaaaataaaatgtttatatttataaataaatttatattttgtattcacatttatactttatgtatatttatatttatatatttgtatatttatatgtatgtattcatatttatatttatgtataaatataatttatatatacataaatttatatttatacataaatataaatacaaaacagtgaagtatgaccttccaggggcacaccaccagaaaagggaaggaagcctcagataggcatgtgtacaactttctgaacacactgagcatgctcacctcccaagggtaagaagggcactgcgcatgcgggcagcccaccctaagagaagaatcatgggaaagagacctgcctataaagtactagaatcaaggttaaacaccggacttcttcttcaagtcgcccactttggtctctttcaagtgtactttcctttctcccctgttctaaagcttttcaataaactttcacttctgctctgaaatttaccttggtctctttttctcccttatgcccctcagtcgcattctttcttctgaggaggcaagaattgaggttgccgcaggccaaggattgaggttgctgcagactcatacggatttgccactagcaactagaatatctttaaccagtaacattcccagcaaaaagtgctaagaagaaagagaaacctgcaaacacactttgttgttaatgaaatgcataaaatcccctgtttctatgtcttctccaactatttttgtttcttaaccacaattatatatgtatgatcttggagcagggaggaattaagaacaggcatttatttcatgcttaggatataaaaagaggaatggagagggaaagacagcagaatttataagttcttcaaagtgatttgagtttttctagccatgggcatagaatgaccaagatctcaggggagcactgcacttacaattcctgcccttcacgcctcagactcccatgaacacacacacacataaaaatgcctgtcttctcctaaagagcaaatttaaggctctgtttcttcccttgagtaccttttctcataaatgaaataaaataaatgaaagtaactttagaagcaatggaaagaaacaatagcaaaagcttaagcaaagatcagaagtctgaaggttggagtattagggttggtgcagcagcttgggggcagcatgaggaaaccaggttcaccttccccacattggattttcagtcttggactcaagtcctcatgatctccagaggactgcaacagctctaagctaaggacattagtgtcatatccactaaaaactcttccaggaaaaaatgtggggcaaaattcttcaccttccttctatttatgaggaatcaaattctccccagaagccctgcccacctactcccctaccatctcatggtggaggtgaccacacatgctcttaatcctcactccagccctaaattgagagaggttcactgtcctcaccaggcatggcagaaaggagctggtgccctctacaccaaaggagaagggggatggctgctcagagagtgtcaagagcttggcaacatttaaacctcactatgcttctaaattaagttgtgtggggaggagagatctcaagagcctcttggtctggtggagttggaacaagccaggccctgaggatgacagtgaagtcaaatttttaatattctagatggcaatgttagcttcagcagttttggaaatgtggcttatgcaattaagatcaggacagactttcaggtactggaataaaagagaagagattagaaataaagtcctcaaaccagggctaaggtcaggcctgcactgaccgagagctgctgggctctggccctgggctgtgaaagaaacagctgctttcttgaactatgaggctgaggacctgggaggaaccacaggccctgtccatggggctgcctggcaaaggattcaagaaagaaagctgctcacacactcatgggcgcggcaccaagcccgagcctggggccatggtgaaagcctcagaaaccaggaccttagagctgggcctgggctcctggagtaggctgctctcagctctgttctcattgtatataagcagtcaggaccttcttggaagcaaagggagagggtgagcaaatgtccccagggctcttgctgagccagattctgttctgatgacaaagaaatagagcacatgctcaacaaataatatatgcatacatattatgtaaactttattaaatacatataatattttgaatattaattatatattgagatagatgtatacgctatgtttctacatttcacattaaaataatatgtacaattgtatagaaattgatatacttttgttgaaattgtatcacctggccctgcaggtgacagaaagataaacaaactataacttcattatcaaggaaatgttcatgtttaatacaaactatctgaagccgaagtctgagttcttcttcctcatcagagagtcagaaaagcaggaggaagaggggcaaagctgggcacccatgtccatgagggcctcctgaggctgatcctgctcagagagggtggggacagtggatgggccttcttgcactgctacaccaaaataccctgggctgggtagattaaaccagagaaatttattctcatagttcacaagcctggaaagtccaagatcaagttccagcaaggttcactttctggttagaaccttcttcctagtttacaggtagtcaccttctcaccatgtcttctcatggcctttccatagggaagcagtgagttagagaaataaaggaaaagagaagagttctctggtttctgtccttataaggacactaatcctattggatcagagccccacccttatgacttcatttaaccgtaattacccctttataaccccaattatctcctacatccacataggggaatagggccaggcttccagtctcagagcacagatggctttttcccaccattcagcacagtggcagctcctcccaggtgccccaggtaacatgtgggacattattctagccttatggggtccctgttaacaatgggacactatcactcttgcttttctagtatttctaagataatggtactctcttttttgtggggtttgtttgcaatctagaggcaggtttgacatagcaacttacaggatttttaaattttgtgatagtaaaaataaataaataaataaatttatcataaataataaattgacttaatacattgaatctgtaaaaaaaagataaggccaattgaaaagcttaaaaagagtctgaggggtttaaaaaggcaaattcctttcaatgagagttagagaacggatgaccgattttttttaatagatgacgtttcagcagtaattatcaaatggtaaacaacaacttgaaaaaaggtctcacaaatataatttcatagtcaaaaaacatttctgagaatcatataaatacatattcagattaaaacagacagaaaaatgtgaccttatcggtagatctactcaatggaaaattcctcaaatatgtgcttgaggcaaaaggaatatttatcattgatggaagttcaagttttctaataaactccaacatccttagtctccgtcctactgactttcagtgtaaactcagtacctgacccattacccctgaacctgtctgagaattcggaggcctggttggaaacctcataaatcaggagctgtggagactggcctggcttctgcaggtaccaatacaaataggtgtttccattattatacaggaggctctaactagacctgcaggagataaaggctggctttccattatgaacaactttcatgatttcttttatgatattgatttatagttacatttttcaagttttgattcatgtcatgaaagtagactttctaaaataaacccattatttaccagccagaagggaactctttttttttttcaagatcttaatcagagtactgttcattgttccctggaggtgaaccttgattattcataagacaaaaatatgaattcttttccctgggcatagaccatgtgactctatcatgttggaataaatgatactgctctgatgagtagaggacaccaggttctttgtctcgagtcaaatgagaaaaaatgacactgacacacttagaatagttttaaggagcagggagtttaataggcaagaaagaagggggaagaaagaaggatgaagctcccctgtacaaagacagagggaggggggctccaaagccgagggacgaaccactctttcaggtaatatcagccagctatatttgatggctggaggaggcggtgtctgatttgcacagggctcagggtattggtttgaccagacatgtcattcacggtagccctcgaaagaactggccctcccaccctagccttttaatatgcaaatacagggcgccatgatgttccacacacgtggggatatgtaggggcaaccatgctgccaggcgcatgttggggcaagggcaagaggacaacggtggaaatcaccatgttgggtgcatgttggatggacccagtttctaacggcttgcatttgcatataaaaggttgcctgcccggggctaagacccagggctttcatgctagacaacagctgtgaaaagtctcccaaggatcccttttttcctctctatctgcctaaaataatatcttaataactcctacctcataaacacgtgaagctgtggagcccacagactcacctcccacccagttctccttgccctggcacatacatccagcttctgtgaagaattggatgtggctagagacttggggtcccacggacaagagttgagatgcaacacggcaagctttgaatagggggctggtcaattgtaagcagatgccatagaaaatcaggaaggtcctccaggcagcgcatcaacagccccgaacatgggcttcccagacatgtctgaggaccacatgattggcaattataccttctgcaccagatgctctctggattcttggggagatccagagaatcgttttctaattatttgcatctttgagtaccatgctcccaagcctcccagaggctgtagtttagactctcattgcgtgtatttagaaaaaaaaaaatagacttggaattccaagagtaggttttcctttgtggtattgattccaactcacaccatagccaagactcaggtgtaatcgtctcttttcttaatgaaatcaggaacagtattaccatgtttgtgctgcaggggatgagaaggaaaaacagttaaggtatagaggagttgtaatcgcccaaggggttcaccttgcctgctgcttagacagagtcgatttatcaagacacggcaatagcagtagtgaaagagtaattcacacagagctggctgtgtaatatcttccaccgtcataattttctcagttatgatttttgcaaaggcagtttcagagtcttcatggccccttccatcaaaacttttcagtgactttcaaagcttgactggaatatgagaaacgctctgagcagctggaggcagtaggaggagtatctggggcaggccagccccatacatctgcttccttggggggtttatgttatgccttgtaacactgtgggaggggcattgtaagtccgttgaccgtaataagttgcaacatcttcaggctgcaggctgctgatagtgagagtgaaatctgtcccagatccactgccactgaaccgagatgggactccagattgcaaattggatgcactatagatcaggagcttaggaactttccctggtttctgccgataccaatttaaataactgctaatgccctgactcacccggcaagtgatggtgactctgtctcctacagatgcagacagggaggatggagactgggtcaactggatgtcacatctggcacctgagattggaaatataaaaacaaacatccattcaatccatcatgttataagaagacctccctgaagagccaggctatactgagcgcaccagctgagtaaattcctagtgttctccttccttacctgggacccagagcagtaggagccccaggagctgagcggggaccctcatgtccatgctgtgtcctgactgggactgactgctgcacggggtgtgaccagcctgttaagaagacttcagggcagggggctgtgctctgggaacatgcaaatcagcaggggttggggcaggctgggcacagctgcggggctggctcatctctgagccagtccctcgtgtccccagtgtcccaagtcagaggagggtagcacagatttgtctgtaagaacatgtttcctcttggggccgttttgtaacaaagaacttttttttttaataattgttaatatttgaaatactcttgagtactcgatgaagtaatgttttctatttgtatatggggattaattaaggttttttttttttgagacagagtctcgttctgtcacctaggctggagtgcagtggcacgatctcacctcactgcaacctccacctgccaggtaccatcgatttctcctgcctcagcctccagggtaggtgggactacaggtgcgcaccaccatgccaggctaattttgtatttttagtagtagaaatggggtttcaccatgttggccaagctggtctcgaactcctaacctcagatgaccccctcgcctcagcctcccaaagtgctgggattacaggcatgagccaccacgtccagccaggggaatatttttatttgtaggaaactcagtaaagttttagagggtgggaacatcaagtcttgaatatactctgcaaaggagaggatactttgttccatacttataacatttctgtgagagtgaaatggttccttcttaaaaaaaagagacaattttacaagataatgctaaatatatttgaaagtattttgtaatgaccttaagccattcttacatgactgtatggtcacgcaattcactacagatgcataaaaatgaaaccacaagtcctcaaggccggtatcactcacagattcaccattatttaaacctgtaagccaccttaatacccagagattatataagctgcatcttatttttggtttggtgatctctatattttaccctctcttctgccattaagtattatttcccaggggttctcagcatgaagagctgactagtgatgccagatctgattgacttaaataactagtttcttcctgcatttatcagagtctggattaggataaacttgaaattatccagggttcagttgtctccacaagtaggaagaccaagattgcatcccctgagtaatgctgaactccccaccagcatgttcctgggtgctcaggtacagctcctctgaatcctggatttctggagagcaggtgatggagagactttggaaaagatcaggacagtaagtcctccctcccagtgagggcagctgctgctcagtgcatgtccctgccttgcacgatgaatgccactttcctcttttactttttagcagtgagtgggaacatcattctgatccacataccagcctcctgtctcacatccagaacagagtctccacctcttatcaagcaaatttccatacatatggagaaattaattggatcctaataaaactggtaatggatttgcacccaatcatatctcacatctctaacagggcccaagacatctcagcctgcttcagcagcagcattcaactacatcagcgtctgtgggctgtagcctgggttctggaaagtattactcatgcctgactaggagtggtcaaatcactgtggtgtaagctctgcacacaccctccttctgtctattcagggacctgaatgttaagggaacttgcttttgtagagggaaaaggggaaagagaaaagcaaaccttctaaaggtttgctgaaaatgaatagacaaaagacaaattaatagaaaaaaaggcaaacaaatgtatttaacatgtggggtgggggtgtggggataacacacgagagggattacccaaataacccagtgaggtccaggtgcttctacatcctttatagggaagagggaagtagagagtatagacaactaagggagagtaaataacctaaaataaaagaaaagggtcctgaaaaggataggtagtagcctgtctggataaagtcaacattcaatcttttctggatttaacttctagtgcatgttaatattccctggtagataaacattcccagggagggttttcatgacaattggcttccttctggagaaactgcccttagacaggtaagggagatttaggaaaagcccctttatatatttgttgttttctaaacaccttcagtttgaagcaatcacaataccaatgtagcatatcttgagatgttacttcccagattccttcatttgcaactgacctgccaggaaacaccattccagaaggttgcagctccaggtggaaaatacaggtgcttttttctaaacggttggagcagtccctgtctgcactgaggactttccctttcaccgtacttctgctgattccccatggccatctctgccctctctgagaaaggcagctccgcctacacgcatggcagaccacagggcttggaatgagtctttcctcagacagtgctatggtttcactgtatcccctcaatttcatccactgttaatttaatccataatgcaacagaattgagaggtggggcctaatgagaagtgtttaaatactgaaggttctgcccttatgaatagattaatgctactataaaaagggcttttattatggaaccaaactggattcagcttgctcagtgcagtaaaaccagttatccaaactgagtttgcagtaggagaaaaaagacatttatttgcaggacgtcaagcaaagaggaccagacagctaatgcttaaatcttgatctctctaatggcttacaaataatggcttttaaaagcccaggtaagtttcagggaatcaaaagttacaggcaaaattgtaaatcaatacatggaggttacacattggctttggcctaagagggcaggatatcatgaagcagcagaatatcttacaggtcatgagtagattgaaaaattttctgatgtgcaattgattaaggaagaaaagctttgtttaaaaattggggtcagcacaaaggaatgttggctctggcctgtgggtgtgactttctccaggcccctcaggtggaaattcagaacaaagaaccatggtcaaatttcagtcccctgtttccccttatgtgaagtctatgtgctggcggatccatttgttggagatctgggtttctgaaaaacaactcagagacatatgctgagatgttctctttagtttctgtagaggaataaaacataatgtgatttttagcttctttgactattgttttagtctattatcatctccttgcttctcatgttgcttgtttacttctcaaggcttagctggacacctaacatttcccttgaaaagacccaagattttcctttatttccatgtctggggaagcttcaaagacccctaagaaggggtcagatccctgaactatctcaattatgagagcgagctcccagtctctcacttctgctattgtcaggccagggcatggccttccttctctctgaaggactcagcattcaaattccatcttgaaagcacagaaattggatcccaagctgctagttactcaatctttgacttcccatcctccagaaatgtgacagaatgttctttactgattacccagtctcaggtattctgttatagcagcacaaaacagacttagacagacagccctcaattggtgatgacagaaggatatgtatacataccccagctccctcccctctcagctagaatagcccagggacattttccccgtgtttccaaatggggttgagcttcagttatcctaagagttaggtggcttgttgaggtgactttaaccttcaacctctgttctctgcctcactttcctccttccctcccattgtaaatatgctgcatgcatagaaatccttcttgttggtggacacaacccaacacagtggacaaatcccagttcttgggagggctacatctcttgtctctcctttttttttgagactgagtcttgttttgttgcccaggctggagtgcaatggcacaatcttggctcattgcaacctttggctcccaggttcaagtggttctcctgcctcagcctcccaagtagctgggatcacaggtgcctgctatcacgcccggctaatttttgtatttttagtagtgatggggtttcaccatgttggccaggctggtctcgaacccctgaccttaggtgaactgcctgtctcagcttcccaaagtgctaggatcacaggcgtgacccactgcacctggcctcttgtcttagttcttattatttctccttttttgatgcatacaaaaatcagaaaacactaaatttctttttgcccatctatcttaaatttgatttatgcagtaatccctttcttctgactcacaaaataaaagaagcttcttaaaatagcagcacacaggccgagtgaggtagctcacacctgtaataccagcactttgtgaggccgaggtgggtggatcacctgaggtcgggagtttgagaccagccaggcaaacatggtgaaaccccgtctctactaaaaaacaaagattagcggggaatggtggcaggcacctgtaatcctagctactcgggaggctgaggcacgagaatcgcttggacccgggaggcggaggtttcagtgagccaagatcgcaccactgcactccagcctgggaaacagagagagagactttgtctcagtaaaaaaaaaaaaaaaatagcagcacaccatgaggtccacattagaggcggtggaataactaacccctactcttaaaacccacaggtcagagagtctccaaatcacaaattatttcctgcttccttgcctcataaaacagccttgtgaattttcatttgactttaggggtgggcagttgtgggaataatgggagttgttttggggataaataaggaccccccaccctaattatatttatgtcctaatatttggaatctatgaatgttaccttatatgtcaagaggaactcggcagatgtgattcagttaagaaatttgacatgaggagagtatcctagattgcctgtctcaaaccaatgtaatcacaaggtccttataatagaaaatacaggagggtcacaattggagaggagcccggacaatggaggggaatgctgttgtggcagaatggggccaagaagcaaggaatctgagagatcttgaagatgaaaacttagtatccaattctcttccttggagccttcagaaataatacagccctgctcactctttgattttagttcagtgagacttctgactttcagaactgtaagataatacatttgtgttgtatgaagccagtgaggtcatactaatttgttccaacagcaataggatattaatgcaagaggaagagatggcttttatctcctcagtgcatggctgttcttgttctcccaaatatcttcaccttgtaataatttcccgtcaattttgaaaagacagagaacatattattttgagaggaggtagcaccagaattcctctaaggcagaaaatgtcttgggtcagatcccttgattggctctggaacaatctgggtatctgagagcctagagatcagctgtcatagcacgtgagaggaggggagattgttctttggtttgtttttatattaggagggcaaattagacttgcagaacacattctgagagggacagactgagccagggaaattggaagagaaagaggagatgtagaaggggccagagaaaagaaagatgtgtccttcctcacaagtccaaaataaagtcatttgcaactcacaaagacattgacagagttgtgttttctagggaaaactgcagatggggctagtttacgattaaggtcagcatggtgtaagacagagagagcaggaagctgtggagtccacactgtccctacggtgtcttctcccttattatagactgtgggctcaactatgggatgaaagtggctgcatgaaagaaatataataaagccacacagacttgggttcaaattccagcccacatgtgctgatcatgtgattttgcataaaccatccatgagctctgatcattggtttcttcatctgtgaaatggaacactgtgtatatcaaggggtctcctgaggacttaatcagatgatgggccttgaagtatgtgtgtgtgtgtgtgtgtgtgtatgtgtgtgtgtgtgtaaatatatatatatatgtatgatcaattgtcatcttgtttatctttctaatatatatatatccagtcctctttttatgtacccttgaccatgctggaataaaaaggctatgtaagatattactagccagacatcactttcaattcaaattcttcaatatttattctacaacaagcaagtgcatcactaagggcagtggggtttcatgtgcatagcttccactgtaaacaattctacctactctttatgtgtggtattagaaagacaaacaagatgacaattgatcataacacttttagtctgagttgtctctgagctgcatttgtgttagtgtctcattctttggctcctaaggttgtgaccacagttctgagttctaattcttttcttcccacatgcacagcctttctcagaattcactctggcctccccatgctgggaatccagactcaccctcctgctacactccccagaatccagcactaactgcctggaagcttttctttgtaagccctccaaacgcaacctctgatagatacctggttggaggagttagcatcttcccatcaaaaaccactgagaagaaggagaaaactgctagcatgatgtcgctgttgaggagatgtgtacagtccacagattttatgtcttcttcaagtgttcttgtctctttcttgaccactattttaatttcatgatcataaaggagggaggaattagggacaacaaaaagatgttcatccttaagatataaaacatgaaactgagacaggaagagagcagaaattatgaactctttgcagtggtttgggtttccttagctataaatacagcagagccaagatgtcaggaaaggacatcacttattctggttcttgcttttactgcctttgacacccacaaacacacacatacacacgcatgataatgcatttcttctcctaaagggcaggtctatggccaacgaggctctttttcttcagtatcattcaaggataagcgacaataattttagaaacaagtgaaagaataacaatggcttaagcaatgagaagagatctgaagtttggcacattcagggttaatacagcagcttggtgacaggagaaaggccccagattctttctacattactgcttggtaaacttgaccacattggtttttctgtcttgggctcaacatctcatggtctcaagaaggctgcagggactgtaagcttcatgtcctctggtaactgcccaaagaggaaatgaagggcaaagctcttcatcacccctctttttatgacggatcaccattttctccagaagtcctgcccctccttcacacccatgacatctcattgtggagctgatcacatgtccacctaaaccttgctcctttcctgggctgggagcggctcagtgtccttgtcatgcacagcaggacagagacagcgccctatacactaaaagaggagagggtggctgctctgtaggtgacaaaattttaaattccactgtgcttttaaggaaagttgtatgaggaggagaaaagctaggtgcatcttcatactgcaacattcgaagaagccgggccctgaggatgaaaacgaagtcaaattttaaatttctcacatgaccttgttagtttcagcaattgtggaaatgtagcctatgcatttatgtaagtcaaggacatactttcagttaccagaatacttgtagagacatttataataagatccttaaatcagggctaaggtcagacttgcactgtctgaaagctgctgggctctggccctgggctgtggaggaagcagctgctctactgagacaaggggctgaggacctgggaaccaaaggctctgcccacaggtctgcctcacaggggcttcagggaaggaaactgctcacacactcatgggcactgcttcaagcccagagcctgccaccaggaggaaagtctcagagacaagggccttggggctgggcccaagctcctggggtgggctgctctcagctctgttctcactggctctcaatgaccaggactgtgctggagccaaagaggtcagcaaatgtccgcagagtcctgactgagcctgattctgttatagttagaaaaaaaaaggagcacgtgctaaataaacataaaattatgtgtatatgtatatatgcatttgtaacaaactttgtatattaaatatgtataatattatagatgtaaattgcagtgatatctttgtatctactatgcatctatattacgaataaatattgtgaaaggaaaatatcttgggctccccaaatcactaagctaaagggaaaattctagctgggaactgaatagggcaaatctgcctcccattgttttcaaagtcagccctctggtccctgagataaatgcatatctaattacctgttctggaaaggctaatcagaaacttaaaggaaggcaagtttttctctcacctacctgggacttgaaagcccctccctgcttccagttgccctgcttttcgcttggagttgtcctgcctttccagaccaaaccaatgttcattttatatatgttgattgatgtctcatgtctcactgaaatgtttaaaaccaagctacgctctgaccaccttggccacatgcctgcaggacctcttgaggctgtgtcacaggaacgtgtcctaaactttggcaaaataaactttctaaattaccttatacctgtctcaaatgttctgggttcacaatgtgatatgtacatttgtataaataggcatagttgttcctgcagtttgatgtaattctaatcagaaagcaaaaaggctagttacctgatggtgaaggaaacatttgtatttagtgcaaccaaactgaggatgaagcctgagtcctccctcctcaccagagtctgacagcagcagaagaggaggaaagctgtgtctccatgtccacgagggcctcctgaggctgatcctgctcagagagggttgggacggtgggtgaatctgctggcactgccacgccaaaatcccaaagcctggatggcttaagcaatagaaatttatattcacatttctggtggctggaagtctaagatcaaggtccaaccaggtacacattctgttaagaactttcttcctggttcatagacagccatggagaaaaagggatgggggttgggaagagagagggagagacagggaggaaaggaagaggagagctctggttgctattcggataagagcactaattctattgcaagggatctcatgcttaggacctcctttaaccccatctacctcgatcatctctcgcagctacactgggggtcagggcccagcttccagtctcagcgcacagagcacagagcagattttccccaccatttagccctggcagctcctcccaggtgctccaggtcacacatgagaccctgttccagccaaagggctccctgttgacagtgagacaccatcatccttacattcccagtatttcttagttcatggcattctctttttgtactgtggaatttgtttgccatctaggggcaggtgtttgacatagcaatacacacgattttttattttgtaatagggaaaactaattcattaattttgcataaataataaattaaactgaataaattacatgttgaaaaagccaaaggccaattgaagagcttaaaaagagcctgaagagacgaaaaagccagattcctttcagaggaggtgtgttagtcacagatgaaagtctttcatttgcagatgactttttagcaacaattaccaacagtaaatgacaacttctataggctgccacaatatgattatatgttcaaaaattatttccaaatattgtgtaaatatatattcaaattaaaacgaacaaaaatgcaagtttatcaggagattcacacagtaaaaaattgcacaaatgaatccttgaggcaaaagaacatttatccctggtggaaagctggaattttcttaggtctttagaagaaaagagaggctctctaggggtaacagctttctctcctctccgctccaccccatgctgctgaggaatgggaatgggggcagaggctgtgaggaaggaggtaggctgtgctctgagcttttgaggcttctttgtaataaatttgattatcctctggttcttcttgaatcccctttctgtctttgatatcatttttttagcattttgatttgagagtatagcccttgggatatcaaaatcatgtaggctgtatgtttgtttccttgttaaatacatctaaacatcttgagtgagtttagaccttatccctgtctcacatcaaagcagaatctacagcgactaggtgctgtcaatcacgtgagtactaaagacgatgatggcatttctcagctcctgctcttgctacttacgctttgtttctctgaaatagcattctgtaaaatcatttacactccacgatgtatttattaggatttttaaatagcatatttaaaagtgtctaatgttttttaatttgagggctccagtctgcttgatttctacataaattttgccctatatctatgaaacctaatagaaatggcactttggaattttagttgcagtggccattgaatccattatcacagaatggaaaataatctccaatatacttcaaatcctaaggctgaagcagaagcttcttgttctgttccttcaatcattcttttgtctctatcacaccatgttctgtcatgtaactgacatgactcatcattaagtttgatggaaatttaaaataccattttaagtgaaatcaactgaaaccttacttttttttgcttttatacctaaaatagaggatttagatatattttctaggaacgatgatgtaatatgtaaacaaggaattttggtaatgtttgaaatattttctcatggggacacaccactaaatttgtcacctctaaaacagtacttaggttaaatgctttttaaattcttaaaactggggtaagaagaaaaaatattatgtaattctgcattattcatgtgacatatttagtgagtctatgttgtccatctgtgagttcattctgtttattttcaaagctcacttttgtaactggaagaactttcactgggatgaaggtaattgaggagaattgaagtattttggcattgagatcttttatttgccatgtgtttaccaagtctatgaatagtcaaacctaaacatttttactaattattttttgccacactcccctgaggacagcttgtgtagaataccttctccagcatgacactggagagggcagtttagtgtacgagtgctaaaaaagatacaaggttgggagaatgaaatgaaaaaaatgatttctcaataggaccaagtatcatcttgtataaaataaaccccaagctggtcatttccaacacgtattccacttgtgttgtcactaatctgcatccacggtctggttgttttgacaagtaaatgtccttgaaaaatgtaggcaagatagggagggatgagctttcattcactctcccttcatcatagctggttgttcccaaggctcatggcccccaagaattctcctcctgatgatgtcttccccaggccatggcagctgatgggaccttaacatatgtgactgaggcacagctgaggctctcatgagccagagtcttcagcagcaaaccctttccctgagttccccaacagcctcctcttccgcagactcagagaccctgcagagctgctcccagacagcagctcatgtgggcagttgggacaccccagcaaggaggtttgtgttcaaggcgttaccactgtgcaaggatattatgtagcttgcatgtattaataaagtcgaatatcctcagcctccaccctgctaattttgagtttaaaatatgtgcctgacccactgctattgaacctgtctgggactccagaggccccattggaaaccccatagatcaggagctgtggagactcgcctggcttctatagttaccaatacaaataggtgtttccattgctatgcaggagggtctgactagacctgcaggagatgaagtacaaagttatgtacaaatattatgagcaagtatcacgatttcccttatgatatggatttatcatttatcttttaaaagattttttattcacatcataaaaaatacgtttttaaaaatgagcttaggccggttgtggtggctcacgcctgtaatcccagcacttcttggtccgcggcaggcggatcacccgaggtcgggagttcagactgaccaacatggaaaaaccccatctctactaaaaatacataaaatcacctgggggttgggggcttatgcctgtaatcccagctacttgggaggctgaggcaggagaatcacttgaatctgggaggcggaggttttggtgagccgagatcgcaccattgcgctccatcctgggcaacaagagcgaaactgggcaacaaaataaataaataaataaataaataaataaataaataaataagcttagtatttactaggtacaagagaccctttattaaaagatattattcaaggcactggtcattgttctttcaggtggtttctaatgattacacataggctcaaagtaaagggagaaagaaagatctatcaaacaaatggaaggcaaaaaagagcaggggttgctattcttatttcagatacaacagacttaaaactaacaatgatcatggctgggcgcggtggctcacacctgtaatcccaggactttgggaggccaaagcgggtagatcacgaggtcaggaaatcgagaccattctggctaacacgatgaaaccttgtctctattaaaaatacaaaaaaaatagccgagcgtggtggcgggcgcctgtagtcccagctacttgggaggctgaggcaggagaatagcgtgaacccggggggcggagcttgcagtgagccgagatcgcgccactgcactgcaacctgggagacagagagagactctgtctcaaaaaacaaaacaaaacaaaacaaaactaacgataatcagaaaggactgagaagagcattacataataatgaagagttaaatttaacaagaagacttcactatcctaaatatattatataagcacacagcagtggagcaccctgatttgtgaaataagttcttagagacttacaaaaacacctagataaccacacaatcatagagtgagacttcaacccacactgacagtattcgacagatgatttaggcagaatagtaacaaacatattcagaacctaaacatgacactttacaaaatggaacaaactgacatctacagaacaaccactaaaaattacagaatatacattcttcccatctacacgttgcaaaaactctaaaattgactacactctcagccatactgcaagtgtcaacaaatacaaaaaataaaaatgataaaatgaaatggaatcataccaaccacactctcaggctgaagtgcaaaaaaagtaaaaatcaacaccaaaaagatctttcaaaaaccataaaattaagtagaaatttaacaatctgctgcttacagacttttgggtaaacaatgaaattaaggtaagaattaagaaattctttgaaactaatgaaaaaaaaagagacaacataccacaatctctgggacacagcaaaagcagtgttctgaggaaagtttatagcgctaaatgtgcacaacaaaaagttagaaaaatcctgaattaacaacctaacgtcatacctagagaaatctgaaaaacaaatgtgaaccaaccccaaaggtagaagaagaaataatcaaaatcaaacctgacctgaatgaaatagagaggagaaaaaccaaacaaaaggtcagtgaaatcaaaagttaggtctttgaaagaagaaataagattgatagactgcaagctagactaataaagaaaaaagcaatatccaaagaaaaacaaccagaagtgacaaacaggacattatcactcaaccctcagcaataaaacaaacaaacaaacgaaaaacccttggaacctataaccaacacctctatgcacaaaaactagaaaacctagaaaaaagtgcataaattgctggaaacaatctaccaagaatctcgcaggaagaagctgaatgcctaaacagaccaataatgagttctgaaattgaatcagtagtaaaaagcccacctatcagaaaaagtcctggaaaaaatggatttacaaccaaatactaccagacatataaaaaaagctagtaccaatcctagtgaaattattccaaaaaaatcaaggtgggagatctcctctctaactcattctatgaaacccgcatctccctgatagtaaaaactgacagaggcacaataaataaaaacttcagatcgctatctctcatgaacataaacacaaactttctgaaaaaaatactagcaaacattattgtgtagcacatcaaaagctaatccaccataattaagctggctttagtcaagggatgcatggttggttcaaaatgtaaaaatcaatacatgagattcacctcataaacagaactaaatacaaaaactacaggatcatctcattagatgcagaaaagccttttgatagaattcaatgccccttcatgctaaaaaccctcaaaaatctagacaatgaaactacacaacttaaaatattaacagccatttatggcaaaattacagccagcatcccacagaattgacaaatgctggaggcattttcgttgagaaccagaacaagacaaggatacccactctcaccactcctattcaacatagtactggaatttctagccagagcaatcaggcaagagagaaaaataaaaggcatccaaataggaagagaataagtcaaactatctctctttgcaggcgatactataatatactcagaaaaccccacactctctgcccaaaagcttctagatctcataaataatttcagcaatatttcaggaaacaaaatcaatttacgcaaatcagtagcatttctatataccaataccattcacaccaagagccagtcccagagcccaatcccattcacagtaagcataaaaaggataaaatacctagaaatacagcttaccaaagaggtgaaagatctctacaacacgaacgacaaaatactgctgaaagaaatcagaaatgacacaaacaaacggaaaaacattccacctgcgtggatagaatcaatacttttgagctggtcatactgcctaatgctatttatagattcaatgctattcctgtgaaactaccaataacatttttcacagaattagaaaaaaaattctaaaatttacttggaactaaactagagctaaaaaaaaaaaaaaaatcctaagcaaaaagagcaaagctggaggtatcacactacacgacttcaagatatactacaaggctacagtaactaaatcagaagagtactgctacaaaaacaggaaccctagaccaattgaacaggctagaggattcagaagtaaaaccgcacacctacaaccatctgatcttcgacaaagctgactaaaacaagcaatgaagaaaggacccccttattcaataaatgctgctgggataactggtacctatatgcactgaaatggaaacctttcactatatagaaaaaccaactcaagatggattaaaggcttaaatataaaatctaaactctaaaaactctaataaaaatctaggaaatgccattcttgacatttgctcaggcaaagaattcatgacatagactccaaaagcaattgcaataaaaacaaaaattgataagtgctatctaattaaactacacaacttcattacagcaagagacactaacaacagagtaaacagacagcctacaaactgggagaacatattcacaagctatgcatctgacaaaggtctaagatccagaatctacaaaaaattttaaaaaaatcaacaacaagaaacaactccattataaaatgggcaaaggccatgaaacagacacgtatcagggagcagtgaaatgagtgctgggagctgcctgaggtcactcctctgctttttccatctggttttaagtcacctaatccatcaaaataaatacaattttgcctcaccaggcacaatggcttctctcatagtcaactgattcaatgatagaacaagtagaaggaatgaatggattgtttcctgtgcttctcaactctttggtgttctcatctcctaagctcaccgtgtgtttcatctcccctctgctgcactaacatccaagtgcatgtgatgcttcagctgcgttacgcaaagcttcattctgaagtctgttgaagttaagagaaacttttaccagaggaaacgtcagtaaataaaaacaatcctgaaattcttctagcttccacattttctctacttcctctctaaaataggtagaaggaaacctaaaagaagttaatcaaaagaaaacatacaagcagccaacaaacataaaaaaatggtcatcatcactaatcatcatggaaatgcaaatcaaaccacaatgagatactatctcatgccagtcaggatggctattactataaaggcaaaaaatgacagatgctggtgaggttgcagagaaaagggaatgctcatacactgctggtgggaatgtaaattagttcagcagttgtggaaagcagtataacgacttctcaaagaacttaaaacagaagtaccattcgacccagcaatcacattattacatctatacccaaaggaatataaatcgttctactatacagacatgtgcacacatacgttcatggcagcactgttcacaatagaaaagacatgaaatcaacctaaatgactatcaaaggtaggctggattaagaacatgtggtgcatatacaccatgaaatactacacagcaattaaaaatgaaataatggtcctttagagctacgtgaatgcagctggaggccattatcctaagcaaattcacacaggatcaagaaacttgatcagacagcaccgtcctgtgggcacagcctcctgcctcaccatcttcctgtcacaataggaggacttttctttttctttctttctgttttttgagaaggagtcttgctctgtgacccaggctggaatgtagtggtatgatcttggctcactgcaacctctgcctccctggttcaagtgattctcctggctcagcctccggagtagctgggattactggcgtgtgctagcatgcttttctaatttttgtatttttagtagagacggggtttcaccatattggccaggctagtctcgaactcctgacctcaggcaatctgcctgccttggcctcccaaagtgatgggattacaggcgtgagccaccgcgcctggccttggaattttcttgatcatggagacaaggatgagtgatatcttgatcagggaggagtgaaatcagtgctgggagctgcctgcactcactcctctgctttttccatctggttttaagtcacctaatgcatcaaaataaacacaattttgcctcaccaggcacagtggcttctctcatagtcacctgattcaatgatagaacaagtagaaggaatgaatggactgtttcttgtgcttctcaactcaagctgaccaagaggctgcctttgctgttctcatctcctaagctcactgtgtgtttcatctcccctctgctgcactagcatccaagtgcatgtgatgcttcagctgcgtgttactcaaagcttcattctgaagtctgttgaagttaagagaaatttttaccagaggaaatgtcagtaaataaaaacaatcttgaaattcttctagcttccacattttctctacttcctctctaaaatatgtagaaggaaacctatttctccttgattatcaggttgtatgtccccagcccacaccataggaccctttgttcaaagtttgtcctgaaccataataagaactaaatggccacatgttcatcatttttttcaatttaatgcaacaattatcatgctaattctttgaattaagaactatcaactggaaaaccagacaagagtgaatagaaacaacatttcaatcttctctgtacccataataaatagtcatctctcagattctcctattctgttaatgggggtaacaacgtcatacacatcagtgtttcagggcctccagcacatctggtaagacagtgatttgacattacaagggttagtgttttggcttttcctgactactaatggattttctcttttctataaggacagctgcccctggacacatgacaacatcgtgaatatacgttgcttcacttttttttttttttttttgctatagatacttccaagtgatgattctggcagaaacatgactgacaagaaaggcaaatccatatacaggaaaactaccactgtcctctggatgctgggttaggtgcactgtactcatttgacacgcgttgttagtctgatcactgatgtgtggttagatgttagtggtttgggaggggtaatgctacttggcaagttgaatgctcagaagagccataggtatgcaagcctcattaactgaaattcatattgttgagctcctgcatggatttctatggttcatgtcacttcctaaaaaatctgggaaagttgactgactgaaggccaagcattcgatcgtcttaattactaagagctggtcctcagtaatggaatagatatgaatattcacttaggaagcatttatttttgatcttgacgtattttcaaagatccagtcacagctcttccaaaccaactttgtctcgagtccttcagttttgtttcttctgaggcctggtgatctctccaaaccaatagccaatgttatggaattgctaatccctctttgcaaagtgtacggtgacttcacccttcgggtttgcccactcttgtgactgctagtctcccagggtatcctttaccatggcagtggtatgacatcaatacagcacccagttatgagaactccatccagcatggcatcattggcagcatatgcatgattggacttccataggatgaaatgattaatttttaacagtaggcagttatccccattcataccctttacccctccacttgagttagaaaaatattttaaggtgtaaatacccattaggtgagtattttataactaaaggttataaaggaactttctgtagccacagcagatactacaccaggtctcgggcaccagtgttcttatggggggaaactgaaatcaccttcacagatttcatttttatataattgttttgtaaatatgcatgtgttacttctatatggatatataaatatacttaaatagacttatttaaagataaatatgtgtacatatacgtatatgcaaccaataatttttcaaaaatataaatgcaccaatatgtatgttatatacactcaaatatgtattttccccaaatgacatcaatttcatggtttttattggtattaagttttaatgttttaaatgttgtcttagtatctctatatatggattaataaatattcatatttatgccatcaattttaataaaatgcatctatctaaataggtagatgtataaatactgtattggtcagtttttgcacaataattattgacaatcaaccacttaaactcttagtgtcttattaacactaagtatttattttcatattcctgaatgttcattttaataatcagttggctgatcccaaggcagggctcagctggttggttcggctgcagggaatcgagcttgtctccagcctatggattgcatttatctgaggccaagcctgaaggacactgactactcagggcagaagattctcatggcaggtcgcaggagtagacaaatcccaaaccaagctgacctgatacaattaagcccgagaatctctaacataggtacacacaactttaattgattctttcacttggtaattattaaagtttctaaaaatgtttactccatttaaacatgaagttatttgataattctatggacatatataattatgattttcaacctttgtaatcttcaaaatgttttcaaatgcaatgttgcatcaatttgaaagtaaagctgggtgtgctttcaacatgtgactctccattgaaattttcttaaatatcctcattgagaaaaaaataaatctctttagctaaaatatcacctaaaacataccttgttaagctttatgtagatcacttgttaccgtgttaaaatgaagattctctttcaggtaatttgaggtgggcctgctatgtatcttgcaaggcaccctctcagtattgctaaggtgctactggattctggatagttttgagtagcagaggactttcatattaagaggaaaaatgctacatccatgtttaggattttctcttgttttcctttttgtcaaggaaaaaggttgtcaaacgattgttataactatctatttatctttttgttttgttttgttttttgtagagacagagtcttcctatgttgcccagtccaatctcaaactcctaggatgaagcaattctcctgccttagcctctcaaagtgctgggaattacaggcatgagctaccacacacagccttataatgtatttcatacagtttcctgatttttctgtttcatctatgacttaatgaagttttcttgctatgaacccagagttgctcgtaagacgtgatagcacattcgagtatattctgggacaatctgtaactggcaaagttttgagccttgtggaaagagcaaccttactgacctgtcagctgtcaattccccatcgctactatcacttctggacgcacattttccaaaactccttttctctctatggtttctttagagttgcttaatgagaggcactcccatgagattgggaagtcagagtggtggattcatgtactctgacatctgaagtaaaacatgtggaattgtttgtggactggagaatcacctggagacgtgctgcaggcagctgagagcatcagcaccccagccctcggcttcccagacaggtctgaggatcatcacacggtactcagcacataccaccaggggcaggtgcactctgacttctgcaggagcacctgagaatcccctgtctctagtggctgcttcacgaataacataccgtaggcttcaaaaagactagtttagactctaatttattcaacttgaacaatttctccttgaaataccgagaatagcttctcttttgctgtgtaaattccaattatcccataacacagactcctcaggtggacttgtatctcttccttattcaatcaggacaggcattgtcacatcttttctcctggggataggggcaaaagaggcttagagttcagaggagcctccctggtcccctctacaaaagtctcccaatgactttcaaaacctgactgagtttgagaaatgctctcagcagatggaggcaccaggaggagcatctggggtggctcgtcctcacacatctgcttccttggaggtttatgttatgacttgtaacactgtgggaggggtactgtaactctgttgacagtagtaagttgcaaaatcttcaggttgcagactgctgatggtgagagtgaaatctgtcccagatccactgccactgaaccttgatgggaccccactttgcaaactggatgcagcatagatcaggagcttaggggctttccctggtttctgctgataccaatttaaatagctgctaatgctctgacttgcccggcaagtgatggtgactctgtctcctacagatgcagacagggaggatggagactgggtcatctggatgtcacatctggcacctgagattggaaacataaaaacaaatattcttactattaatcatgttatcagagaacttccctgaagttccagtcagtactgagcacactggctgagtaaattcctagtgttctccatccttacctcggagccagagtagcaggagccccaggagctgagcggggaccctcatgtccatgctgtgtcctgactgagactgactcctgcacagggtgcgaccagcccataaaaaagtcttcagggcaggaggctgtgctctggaacatgcaaatcaatcagcagggcatggggcaggctgagcacagctgcagggctggctcatcttagtaactcagcacaggggcaatgtccccagggtcccaggtcagaccagcgcagcatagatttgcctggagggaatgtatttctctctagagccgctgttgtgacaagagatattttgaaggaaaaaagtcaaactttaatacaaacctaaggactatatggaataatatattttagagttgtattgggagtatacaggagagtataaccattcgtagggaatgtctaatgaagtcttagagggtgggtctatcaggccttcaagttacttaaagggatgtggagagtaacaatcccttttgctatagtaacaacacctctgtgattgtcacatggttcccattgtttcatgtgagaaaaacagtctttatcagaagcatatttaatacactccaaagtatttgtagtgaccttaaacatttgtaattaccagtatatttacaagcaattccctgcagatgcacgataatgatgctgtgattcctcagcgcctgtgccactcatagatcttccattatcagagctataggtctctgtaatacccagggtctcaatgggcagcagcttcgtcttggtttggggctccccttattctgcccatttttctgcccttgggtattatttcccataggtcatcagtatgaagggttgattagtaatgctagatctgtttacttcaaaaaacatctctgtttcttcctccagctgttgaagcctgaatcaggatgaacttgaaactctgggtcaatctagaaccccacatcaattgtctccaaaggaagaaggccaaggtaatgcaacttgcctaatgctctgatctgcttttcccaccataatgtttgtgagtgttcaggtgtggctctcaaaaatcatggctttctggaaagcaatgggagggagaggccctggggaaaggccaggtcagtgaacactttctcttctgtgagggtggcgaccactcagtgcatttccctgccctgcaccatcaaagccacttttctctttagcagtgagtagggacatcatcctgactcagacgcctgcctccttgcctcacatccaggaaagagagtctccatctcctgtcaagccaccgctcatgtacacggagaaatgctttgaagctggataaaacttggaaacagatttgaacccctatacctcacatgtctgcctctgcccaggcatcccagcctggttgtgcagcaagggaagtggaatcaactacatcgacatgagaagactagaacctggggagtccagggagcattactcatgcatcactaagggtgggcagactgctgtggtatagcctgtacacaaccccctgctcctttccaggggcctgaatttcaagggcagttactggtaaactgcttgctaagatttaggttcagagagaagcagttctggattgcaatacacaatttcgtgtgtgtgtgtgtgtgtgtgggggggtgaatatagttgtcactcttgctaccctttcccttttccctttgctgtacttctgctgaccccccatggccatatcttttcctcactgctctatctgaagctggagaaggcagccctgcctgtacacatggcctatcacagcacctggaatgagcatcctctcggaaagccctcaatcagtgaggacagggaggtgtatacataccccatctccctcccttcttaggtggaaaaatactgagacattttcccatgtttccacgtgggcttgatctccattcatcctctgtggtagcttctcgctgaggacattttcggtatcgctgctctctttcctctctcactgccttgtttcctcctagtgtttactgtgcattataaatatgctgcctgcatgggcatcattgtccctgaaagatccaacctaaaacagtggacaaaccctcattcttggaaagtatagtctgaatacttgccaattctttttttttcatgcatagggatattcagaaaatttaggaaacagctgaattatctaggaaagacagcgtcatcagaagggtctttataatagggaggagtgggggtaacagtcagagaggaatagggacaatggacagggatgcttcagtgatggagaaaggggccaggcagcccggaacatggggctatctttgaagatgaaaagctgagaatcagattctctcccctggaacttccagaaggaatatagaactacggataccttgattataaatcagtgagacttctcactgccagaactgtatgataataaatttgtgttgtatgaaactagtaagattctgataacttgttacagcaggagtaggaaactaacacaaggggcaggggtgtcttttacctccttaagggcatggttgccctctgttcttccaaatatttttatcttgtcattttttagtgtcaattttagcaagacacacagaaaatttcactgtgaagatggctagcaccagaatccttgttatgtgtaaacactcttgcataaatcccttgattaactctcgtactctctggatatgtgattaactcttgtatcctctggatatgagaaaagtaggggaatatttgttcatttgttttcatattgggggagaaatcagatttacaggacatcatttgagaaggaaggactgggacagaaagatgagaatggtagaaaagatgcaaagtgttcagggcaatgcaagatgtgctcttgccctcgaatctgaaagaaagacatttagtatttgtaaagactttgaggaagttttgctttgtagacaaaactgcatgagagcctgagtttataattggagtaatcacggtaaggtgtagaggtagcagggagcttgtgttgagaatttcacaccactcttctggctttgtctcttctttgaatttaaaggccattcaatcgtatatgaaacaaacgtggccatgtggaagcaacatatttaaggttatgcagacctgggttccaagctcagccctgacaattgctgaccacatatctttgggcaaaccatctctgttgaatagtttcaactacgggctctgataacagtttactcatctgaaatgtatcaccaagggtattaagggctgtcctgagggtttctctagttgatgaaaagactgcttttcatacatatatatgtgcatatatatgtatgaaaagactacttagggtcccttttatgcgtccttgagtatcttagaatgaagattctagataagatactactagtcacatgtcatttttttgtattattacactttaagttctggggtacatgtgcacaacttgcaggttacataggtgtacatgtgccatatgggtttgctgtacccatcaactcgtcatttacataaggcatttgtggtcaattttagaataagtgcgatgtgctgctgagaagaatgtatattttgttgatttgggatggagagttctgtagatgtctattaggtccacttggttcagagctgagttcaaaaagtcctggtttggtgggttttttgtttgtttgtttgtttgtttgttttggaggcagagtcttgctctcttgcccaggcctgagtgcagtggtgtggtctcggctcactgcaacctccacctcccgagtttaagggattctcctgtctcagcctcccgagtagcttggactacaggcacgtgccaccatgtctggctaattttttgtatttttcagaatttctgaaaaattttgtatttttcagatttttcattgtgttagccaggatgatctccatctcctgaccttgtgatccacccgccttggcctcccaaagtgctgggattataggcgtgagccaccaagcccagcctcagatgtcattttcaactaagaactgtcaatatttattctgtaactaacagatgcccctgtatatactgggtggcttcctgtacaatgtttccatcataaaaatcttcttctaaccaattatgtgtaacattagagaaatgaaggtggagagtgcaaatcatcatactacctttaggctggacttatcctaagccccatttttattagaattcttgggctgctataacaaattactaaaactttggtggcttaaagcaacagaaatatattctcctcctatagttctggaggccataagtccagcactagtttcaggggtcaagagcaggctgtcatcaaagcttctgcagggactccagcggggagtctactttttggcttcttccagcttttggtggcttcaactttctttggcttgagtccacatcacttcaatctctgccactgtcttcaaattgccttctcttctgcagactttgttaaaatgtctgtctatgtctatcttataaggacaatcgtgatgtccttataagagagatagacagacatttaataaagacaggcccatttagggcccacctggtcaatacaggataatctgcccaattcataatccttaatttatatatgcaaaggcccttttcctatataaggtatatgtatcggctgcatggaatagaacctgagcatttgagcatcatactcaacaataaaccattaaagaacatactatcagtgttggtactatacacacatcacaggctcttctctctctctcctcctttctctctcttccttgtgactataaatttcctcacttccctaagtgtatccagtgccacctatgtccaggttagagcagcacacataggaaggccttgctgaggttttgcttagagacctgctctatccctcattatcattcagaaagaaggacacagccaaagacagccctcagccatctggggagcagctgtctttacagaggacagtcacaggctatcattctctggacctctgtttatcttcagatgtctgtggccctcagccctcagtgagggtctgtgtggcaactgattcgagtaggatccaacaggacccttatcagaacatctggttcacagaaggcagtgagtataaggtaggagatcatcagggcttgtattctgagcactgatcacaacactggtcatgacaacgctgaccagaacaggatctggacaaaacaggatgcactacagaaactggcccaaaccagctagaacaaagatggtgacaaaaacgacctctagagcacagtgtgagtggatcttcccctgggggctcccatcagacagagtggcagccatggctcagtgctgggtggtcatagtatgaaacccccccacggtcttttcatagcccccctctgactgcagtgatgtgggatttctctgtccaactttcatggctccagcagcttccgggactctgttcacagtgggaggtcatgaaggtagttaggttactgatggccagagtgacgtctgtccagactcacccccttgacccaggcaggcatcgtgtccagggagcagtgggagccagcaggagctcagtgtcagcccttatttcacaaggagctaggctagacactgttatttccctgactggctctgctggtgacagtgaccctgtctcctggaacacagggaggggcctggagatgagcaccacacaatatcccaactgtcatataaggggggaacaaatatgaacatccccaaatattaattgtaagtacatacttcattcagtttgattaaattctgagaaagcaaaatgggctaaaaacttcatcttgaaggaaacattcatgtttaatgcacagaaactgatgatgaatcttgagtcctccctcttcaccagagagttggaaaaacaggaggaagaagagcaaagctgggaccccatgtccacgagggcctcctgaagctgatctgctcacagagggtggggaagatggatgagtcagcttccgctgccacaccgtaacacggggctggatggctaaaccacagaatttaattttcacatttctggtgcctggaatatcccagatcgacgttcagcagagtttgttttctgctaaagaccttattcctggtttgtaggtgccaccttctcaccatgtcttcacacagcctttccatggaggggaaggcggttagagagagagaagaaaaaggagaggtctctggatcctacaaaatcatgaatcctactggatcagggacaccccctgccatgacctcaattacatctttagaggttctgatttctacagtcacattgaaaattagggtttcaacatgaatctgagggcacaattcagtccatagcaggtgggacacagccaaggccgtgcttccagtctcagggcatggggcaggttcccacagctcagcacacgggtggctcctcccaggtgcccaggtcacagggaagatttgactctaactctagggctccctgttgataatgggacaccagcactcctacttcccagtgttcctgagaccatggtgctgtcctttgttcattgtggagcatgtgtgccatcttcaggcaggtctttgacatagcaacttatgggacatttgattctgtgattgtgaaaattaattaatagattaattagtcataaataacaaattaaacaatacattgaatcagaaacaaaggagggccaaatgaggagcttaaaaggagtctgagtgtcttaaaaagacgtattcctttcaaacaagaacagttagagtcacagatttttttaacaataactttttagtagcaattatgaaatagtaaatgataacttcaaataggctactacaaatataagtttacagtcaaaaaatattttcaagaatcatgtaaacacattttcagattaaaacaaacaaacaacgaatgtgggtttatctgcagatccactcactggaaaacttctcaaatgtgtgattgagtcaaaagtacatttgtcactgatggaaagctccaggtttgttttttttttttctgtttttgtttttagtctttagaagaaaacagctttctctccactctgtcccacctcatgctgctgaggatggctgggcaggcaatgactgtgaggaaggaggaaggctgtgttctcagggtgttcgtgcctcctgcccaccggagtgacctcacggagcagagccacctacaccaccaaggccacctgcctgcctctgcactgccatggcaacagacaaagaaaccttgttacatttagttcaccatattatgaggcttctttgtaattaaatttgatcatgctctgattctccttgtatctctcccctttcagttttggggatcatatacttttcactattttgacttgagaatatatgcctttgggatatcagcatcatgtaggtggtatctttgtttgctttctccaaaatataactaactaccttgaatgggttttcattttatctcctgtctcgcagaaaagcagaaactcaaggtgactaggtgctgtcaatcccaggagggctaaaggtgacgatggcattgcttacctcgtgctcttgctacttacattttattttcttttactgcattatgtaataaaatatagggtcaatgatgcattaattagtatttttcaataacatattgagtgtctcatatttcttagtttgagagctccggtctaataaatatctatgtacattttgccacgcaacttttaaacctaacagaaatgacacattggaattttaattgcacttcctatggaatctgttatcttgaaataaatcatctcaagtattatttaaacccttagcctgtatcaggatcttgttctgttgattcagtcttttgtgtctctacaccgtgttatcacatgtgacagacatcactcattactcgggttcgtgtaaatttatttggcagaatgatcagatcatggatgcagattagtggtaacacaagtgaaatacatgttagaaatgactggtttggggatagttttttgcatgataacacttggtcatattgcaaaattgctgtcttcccactttccaaactttctcctttaccactcacacgaaactgccctctctagcattatggtagagaaagcactgttgcttttttaacgaaagcatttctgttaggtttaaaagttgcatgacaaaatgtagatagatatttatcagactgtagccctcaaattaaggaagcatataaatttagagcactattgtcaatggaatatattaagagcataatttttctatgcattaacaactaaaatagaggattcagatttattttcaggaatagtatcatataaaaataatgcatttattcattctttgaatcattttcttatgacaacatagcactaaaaattttctctttaaaatgctatgtcagtaaaatatttttaaaattctaagaatttgagaaggaaataaaaatctcatataattctgcattgttcctgtggtacattatgtaaactttatgttctccatctgaattattttgtctattttcaaagcccacttttggaattggaagaactctattttcagtcagcaaaaggcaactgaggcaaatcaaactattttggtattaggatttatatctgtcctggattttaaaaatccataagtagtaaaaataattatccttggccatactcccatgaaaatagctggtgcagaatgctttttccaccataatactagagagggcagtttcatgtgagtaataaaggagagagaaagtttggaaagtgcgaagacttggctccacccaggaagccatgcagcagtgctttcaactctgtggttcttcacaagtaacacatttggcccctttttggatccacatcatcaactgccatcaccaccaccagccacatccccacccaccataatcaagggcagtgtaattgaacaatagctgatctctcttatgttctcttcatgctcccattcctgcagtctgcccaatctcaaattctgaactttggaaaataaaactgtttacctcatcctgtattttctcagtgatccctggaaaatactacatctttagtatactgcatcttccagtgtatgcattttatttttaaaaccaactttcaaaatttcaagaactccctttttctatcagcaagaggtaattgtaatcaaagagttttagtattaggaacttgcgtctgctatgaaattacaaaatctatttgacactcacaaccaagatcttactgattgtcctcagccagctccgccagaggagaattagtgaataatcctgtctctactgtctcatggagtggagaagaatggcaaacaggagaagtaggaatttaaaaagtgggaaaataccaattttacatataaccaaatattttctttgaaaggtacccaaaactgttaaaccctaaaatgtactcaacatgttttgccagaaatgatcagtagtctggcccttttgctcaataaatttaaacaaatgtaggcaaggaaggaggattcagatgagattccattctcctttccctatcatcccagttttttactcacagggccctagaacctcctcattttcctgttggttatgagagtcaaggctgtggcaggtgacaggaacataaacaggggtgctgacctgccgcagtggctcacactgtactgccagcacgttgggaggccaagtcaggtgggtggcttgagcccatgattttgacaacaggctgggcaacatggtgaagcaccgactctacaaaaaaatagaaaaattagccatgtttagtggcatgcacctgtagtcccaggcagagtcctcagaagcaaaccctgccctgtattctccaacagcctcctcttttgcagactcagagacgctgctgacctgctccccagacaagcagtgcatgtgagcagctggggcaccacagcagggaggtttctgttcagggctgtaccactgtggaaggaaactctatacgttgcatgcagtaataaactccaacatcctcagcctccaccctgctgattttcagtgtgaaatcagtgcctgacccactgccactgaacctgtctgggactccagaggcccgataggaaagcgtatagatcaggagctgtggagactgccctggcttctgcaggtaccagtccaaataggtgtttccatcatcactatccaagaggctctgactagacctgcaggagatggaggccggctctccaggggtgacgggcagggagagtggagtctgggtcatcacaatatcctcactggatcctgaaataataacagagaagtgcaagtttatatagatacattatgagcaactttcataatttctcttgtgatataaatttacagttacatttttaaagttttgatttatatcatgaaaagtagactttctaaaatagacccattatttattagccacaagggaactcttttttttcaagttcttaatcagagcactggtcatcgttccctggaggtgaatcctgattattcataagacaaacctgaattccattccctggagcatagaccatgtgcctctatcacattattggaataaacatgtgaagctgtggagcccacagagctcacctcccacccagttgtcctccctcatctctttctgtccttaccagggacccagagcattagcagccccaggagctgagcagggagcctcatggtgagaaggtgaactgaggagtcctgatcagtcaaggcaaggatagagctgagcttttatctcagactcacaagggaaggtccaccctaggggacaatatgcaaatcacctggtgggtgcagtggtgtggaaaaggttgacggggcagggggaatgtctcttctgtgaacaatgtgatataaattgtcctttggaataaaacagaactagattcagccaagtttgcccacaatcaagggaagaaggatctgaaggtgaaagttcggaccttttgtagggacacactgtgtagggcatgactgtaagaaagcaccagaaccctgacaatgtggaaatgtgtgtctaggatacatctctgggaggtgaatgccatctggcttgattccctcccagtcaatctagagtatgaaacaggcccatccccacaagcactgctgaactgagagcctgcaaataaaaagcggcctggagccagttcaagggctgtctggtatctactgtttccaggataactgttcaagaatgttcaactcaaatattagaatctactctgccttggcacctggtgagtgaacagcataagagctctctgtccaagcgcctcacagggagaatgatgtgagcctctacatttagagccaagagcccagtgtaagaaaaaggaaagagagacaaaattttgtgcctccagcagcaaatttaaaattcctggtgaccagttgttcaatctgggatctatctcatcataatcgtctcacacatacaaggttaaccagagggctctttcttttttgttgtttctgtttttgtttttagtagagatggggtttcattcaccaagttgtctgggcttgtcttgaactcctgacctcaggagatctgcctgccttggcccctaaggtagtgggattacaggtgtgagccattgtgcctggcccagaggactctgtcttaagggaagaatcttctagattaatgatacagaacaaataagaaataactttgcatgatgttttttcaagtgatgattagaaaagctcttcccacacagtctccctggtcatgtggaatcaggtcctgtcagggcttccaggttctcgtcaactctgagtgagacgtgagtctcccccagcctggatgtggtgcagccacagccacgagtccacagatccaaaggaaattctctgtgtataaagagcaagaactgcattcacagttttacatctctgggtaacctgtacttgtaactgatattttcttgactttatgtaaaaatgctcacagcttagggatgtgaacctaccatacaactgatcattaaacagaaaaacaaccacactgttctttatttgtcatcgatgtgcttaacattccattgaacagctcctgaataatggtgccaacaataaatagtttcacaaggacagtcacatttctgaaaaaaaaataataatccagtaacaatgaaggactagcttgtagtgtgatgtaagcttgggtaatttaacacaaagccatacttaattgcccaagaacacaaataaatgccattgtaggtaagactgcaaagaaagcttgatctgaatatcttctggggaatctaccaaaatatcattttttaataagatcggaaaacatacttgattaaaaatgatattgaccttcaaatgttgaactccatgacaataatatgggctgatgatattaaacagtagctacgaggaggtattgaaataaaagtctcatatttcactgttaaaattttatttattcttttctcttattacatgttgcaaattttgggtacccgactttttttctgatgatgtcagcaaattctgatctgcttcttagtgttgaaaaggtcagactcttaaccatggtagtgaaaaaaagtcagaaacatctgaagctgaaggaatggaagaaggagacataaacagcctaactaaaatagaacaaaatggtccattttattgttagttttaaataattattctgaaagggtgttaaatcaataatcagttttatccattatctaatgcaaagatttgaattgcaggaaagtgattaacagtaaaaaaaattgccctgttttcttttactgtaagccaattcttgaaaatgttattttcacaaagtatttagattgcttgaatttaggagagcattgctgttttctatgagaatgaatgaaccattaaaaagactacccctgggatttttaacaaaaatctcatgatttgtcgccttacatatctggaaaatgtaaaaacttggacaaatccttttttagtcagaaaaagcctttgaaattacccgatttaaactgtagacttaaagaacactattactaattctaaccagaatcctccctctcttatctgttgatgcatcctaccagggctttcacagcagcagacaaagctggtcactctacagtggacacagacaagatggaagagcaacctacatttgaaccagggtgggagcaggcctctatgtgtctctcatctgaatcatggtcatctgaatgagggaggatttctacaggcagggtttagtgtggctgtgtctccttttcctgattggttagtttgggatccatgtaattgaaaagaactgtattactcatatgacttgagaagagagtcttggaagtggaattgtttgtgttcattaccgggaatcagtgtttatggggtggacactgtgatcctgtttgtaggggggttgagggatttgttggctgaccaaggaaaaacagatgaccacagacggcagtagcacatgtgacctagtctattgggtgaagctttgacaggtttacagcaagaagtccctcacagcaggtggtagtccagagaatcaggtgccagggttgtttctcaaaatgtgcaggacactgtagaagggatatgcatttaggggatgccacacagcagcacagtggggagtttctgtgtcagagagctacagagaccagtattaagtttaaggttttcataaaccggggcttgtcttacctactgctagcagatgtgggtcaggctttctggatatgtagattaagtattttctaaaaggttaaaactattcttatttttgtggtttttaaaacaattacgttttaaaatttgagtttggcacaggccattgagaaataagcccacagttttgaaataaacaacatagcattctcatttatagatccctgttgcacatcgtgtagactttgttctacagactgtattagtccagacagtgcaaacccacactgttatggatgaggctgagacacacagaggcctgttccctacctgagcatcaatgaaccttctttaaattaaaggtgagagtttgtccttagatgagaattaagaccaagtcacccacaaatggagcttccatctgtgaagctacaggtcctgtgaatggattcctggctcccaggcacctgggaatgaagccgtctgcgttgtctcactaactgaaattgtccctcgctggaacagagattcatggataaatattctggaacacagggagagagcacagggaatgtaggctccttgaatgtgtgtcttctgcttctgagaatctctctctccaaacattgaaagaaacagcattgtttccatatcagacttttctgaatcttcggaccctgttctagatctgtctcatctgaacctgtttccaaatgtttcaattctggtctctactttttcttggaaaaggttttcagaaatcctatgaaactatccacacagctgtgggattaagtggtgggcttctcctctgtgcttgttaatatctctggagaatccaccacacccaccaactgcacaaagtgaagttatgagtctgttttcttcctgagcattctgtgtctcataagttcccctcgaattcacatccttgaagaaaggggtctccgtcctcaaaagtaaaactctataaaaccatagcttgcctgagaagttagtataatttttctactctttgaatgtgaagttagccttgaggccttatagtaaaacctggtttacttgagagatgggaaatgaagatcccaagaagtttttagagactaaattggggattctagccatttaaactgtagtagaagctgcagttgatataagaacttctatgaatataacaagaaaataaagtggaataacttatttcttgtaacttagataagaacttcaatgaatataacaagaaaataaagtgcaataacttatttacttgtaacttagataagatagtttacctgtagaaaaaatgaaaatagaatttgtgagttctcacatcgtttttttcatgttaaacaattttaagaatcaagcaaatgtttatataaattataatttataatgtttaagactctagagaaaaattatggttcaaatcaatcaaactgagttctaaagacagctgaatttttcctttaactgcttcttttcacctcctgttagcaaaaatcaaaagtacagaaaaggaaacagacaagagctgaataaagcatttagtgctcatttcttgtcttataataatactattaataattaataataataatacagcctctgcattgacaactggaaatagtgactctgcccttctggaagcagcagcttcacatcacagcagtgaacttcattataacttggtgattcttgggcaggagctaaggatcacccaagtgtaaatgctctgtgaagagccagttgcccttatgttggaatacttctagatattaactcttctaaaatatctaccagcaaaaaaaaaaaaaaaatgaagcatcagtaataaaatgaaataaattctgacttcccaggagcagtcaagaataaaactatcatgtttaacagaggactagaggcataatttcctgctagctactgatttagctggatcttactcatagtaaatagtcttaccttagtaaattagaaacatcctcaacctagaaaatggtttcttttgtattctggaatcctagcagtcctaggcaaaaattaatactgaaaataagaaggtacacaaatctgttataacaggaaaactattatacaattatttgtataaggcaaaataaaaggaagaaacctattgacttatggaagattaaagcaaatacttactagtcattaatagtcctaataagccataaagcaagagtaatatcttttgtctctggcttgtgatggtattaaatttcaaaataatgattttgttttgggttaaaactaacttcataggttttctcagagtaggtcatcttactcagaagttatagaggaaaatgaaaataaagaaaaacctattatgaaatttgccccaggttaacctttgcagagagactaagagaaggataccatttaaatgatcctattaatagcattaaaatatttaatttgctaggcaaatctaaaatcaaccttttctctagaatttgaaggaagacaattatatatttagagaatttgacttgagtgtccttgtgagtggctgacagacaaacagaccagatgaatgttggtgcagtagaatcaaggacatcacaacattaaattttcctcattagagagcaagtccagatactgcaccacgaccgggtcaatgatcagaaaattacttgggaactctttgtggctgcctagtcatattgtggctgtggttgagaggctgatttcccctggctggtattgccctgcaccttgaatctgggcattcgtctctactgctgccatcaaatgccactaaatggtgtccccattaataaggcctttgtaatgtgtgtaacataaagacggagtgaatcagagttcaggattacaggaatatttattttattccagtgttgttaatatgtgtctttgtctttcaaagaaggaagccacaaataggacttctttggtttctggaggctacatattctacccgttggaatacaggtttggcccagcaggtgacatgaaagtcagccagtcgtgagtgggactcaggatagaaaagggctctgcagcagatccaggttgaagtgcaaacggcccagcctcttgggccactgcggatgcaaacgacttcaacaatgctatcaaccatctggacaaggctgatacttagagaacactccaccaaaccacagcagattccatggtctttcaaaacattggctaatgatacactatattttgggcaacaagatatttcaaaaaaaccaagctgattaaatcaaaaaaataaattattcataactgaggggattgtattagaaatcagaaacagaaagttatcagaatggggttggtgggagaaggaggaggaatgaaaaattacctattgggcacaaggtacactgttcgggtgatgggtagctaaagcccagagttcactactatacaattcatcagtgtaaccaaaaacaactcttaccaataaagccactgaaattctaaatttaattttttaaaaatttgccaaaaagaatctaaatatttggaaaatatgtaaagtaccactatatgtagtttggggcaaagaagcaacaaaaagggaaattaaaaagtacttggatctgaaagtaaacatcacatatccaaatttatgagattcaaaaaaatgcagttaatttatagcattatgaatgtgttttagcaaagaagttttcacatcaatcactggaaatgtaatcctgacaaactaggaaaaaaagaataaatgccactcaaaagaagggtcttttattcttagaaatgtgaggatgtgacaagcacacatctagtattccaccaatacagtcatatcagtctccaaatgaaaacaccattagcagctgcacaagaagaaagtcttagagtggacgagcagagtgagttactgctcagagagaatgaggagtcagggaaagtcaaaataggattcctgtgtgatattattatgagctgcacaaacatgagactgccctgagccctgacttactcataagccgaacatcatggagtgcaggccattttccagcctcctgatggttggtgagagtggggtcacttggcaaaggcatggagactcgctatgaaggtcatcagtggcagcaggtgaggacaggacacactagggttcccttacagtgacatgactgagcatccctacagccatgagaacagcagggaaccttaggggctgctccagggatgatgtggcagcaaaccctggagggttggtggggcttcagcgccctacatgtggaggaaagaggaggctttggaaggtgtcctggaggaccctggccctgttcacacagaagaggagcctgtgcctatgactaaggcctcatggcctcttccttcctcaaaggctttccagtcatctccctgagcccacctgactccaactgctggagacacatcccctggcaccgcacctgctcctgccacactgagaggctgaacttactttgaggtttgtgtttggggccatcacactgttcagggacccggtgagtgtcctgctcacaggaggctgtgcagcatttccaggctccaaagtggtgtttgtgatggtgaaatccctagaattttggttagatgtgttttctcacttgtgaataccttctgtagacctgtcattctgtgctttacaaactcttttctgtaaactatctattctttgtttttggacttttgggttaagaatgtaattttaattgtactatctttagtctccacactgctgattgtggaagtgaaatcaacgtatttttggttggatgtgtgttctcactcatgaatatgtgtagaaaagtcctctgaagacttgtctatctttgtatgtgtgacagattctttctatataccatgccttcattatttatttattttttgatttttctcctggggaatactgttttaacttcacttaccatggtgtggatcatcctagaatagacaatcatttctgatgggtttgattattttaaccagaaacaaaggtattttgtcctatgggtgcaaacacttctatgtgttgattatatcacctcatgaaatggaactgatttgcccatgattcgttcataaatatttctgaagaattattttaagtgacaccatgcaggccgggcgcggtggctcacgccagtaatcccagcactttgggaggtcaagacgggtggatcatgaggtcaggagatcgagaccatggtgaaaccccgtctctactaaaaatacaaaaaattagccgggcacagtggcggacacctgtagtcccagctactcaggaggctgaggaaggagaatggcttgaacccgggaggtggagtttgcagtgagccgagatcacgccactgcactccagcctgggtgacagagcaagactcagtctcaagataagagaaaacaaaacaaaacaaaacaaaacaaaatatatatatatatgcacacacacatatatatacacacatatatatacatatatatacatatatacatttacttatttcaaaaccttttattttttgtgataatttggtacccaaattgtcatttctaaatgaccagtaagtttcaaaaggaatcttcctactttggggcaacgatgtaagggttgaaaggctaaagaaccactgcaagaacctggagagaaaacaatacaaaagtttatattaataacatcagagaacagtagaagaaatgagaactaagtgacctaaaattccaaagtgaaaagcatcccttctagtttagctgatgctggcctgactctttgtcctcctgccatatctgccaagtttgcatgtggacacagtctctctcttggcacaagcagaggaactctcctcagaaaggagaatcagattgaccatcaggagttgcacagagcagcctctatacatggcccgtgtcctccgtagggcatttgctgaggtctgaatcatcaggcaggctgtaggagatgggctagaagaacataaaactcccacggactcagcatgttcttccaaatccccaaagatgcacagagcatcctgaatacatgtctgaatcgtgcacattgacctcgaaccacactgatcccctgcaagtgtagaccctgcctggccttgtgctctgcatgtcagtggttgtgacatctccagaccgaaccagtggtctctgctaaacctcctctaggggcagaatgagtttcagaagctctgctttgctgttgggatttgacttaggactgagtgacattacctcaggtctccttgcacagggacttcactaaatctttggtgattacacacctaaagcactactcacgactttactttcctgtgagacttccagtggcacaggctccacccaggaagccaggcagcagagccttcaactctgtggttcttcacaagtatcatatttggctcctttgtgggtccacatcaactgccatcaccaccaccaaccgcatcccacccaccataacccaaggcagtttagttaaacaataactgacctctcctgtattccccgaatgctcccattcctgcagtctgtccagtgttgaattctgcactatggggaacaaaaaggtttttatcatcctttactttcccagtgattcatggaaaatactacatctttaggatactacatctttcaggatttgctttttacttttaaaaccaacttttagaatttcaattactccctttttctatcagcgagagacaattgtaataaaataattttactattaggatcttgcatctgacatgaaattacaaaatctatttggcattcacaaccaaggtgttactaattgtcctcagccagctctccctgaggataactagaggagaatgccgtctctactgtcttacggagtgagcaataagtgttaaatagaaaaacagggaagttgaaaaagtaggaaagcacttggatttggataaaactgaacacagatttgcacccattatatctcacacctttaacaggggccaaggcatatcagcctggtgcagtagcagaggaagtggattgaactacatcagcatcagtgggcttcagcctggggttctggggagtattactgatgcctgactgggagtggtcaaatcactgtggcggagcccctgcacacaccctcctgttgcctattcaggggcccaaattttgaggaacttactcatttagagagaaaaagggaaacttctcatttgccctctaaaggtttgcagaaaatgaacggacaaaacgcaaattaatggaaggaagaggcaaaaaaaaaaaaaaattctgtaaaatgtaggggaaaaatcacagggtctcactcggttacccaacatgaagtgcagtggtgtgatcatggctcattgaaaacttgaattc

SEQ ID NO: 7192 - protein, 309 aa, Homo sapiens; identical to SEQ ID NO: 3191

SEQ ID NO: 7193 - protein, 118 aa, Homo sapiens; identical to SEQ ID NO: 3302

SEQ ID NO: 7194 - protein, 622 aa, Homo sapiens; identical to SEQ ID NO: 3377

SEQ ID NO: 7195 - protein, 630 aa, Homo sapiens; identical to SEQ ID NO: 3819

SEQ ID NO: 7196 - protein, 1408 aa, Homo sapiens; identical to SEQ ID NO: 1332

SEQ ID NO: 7197 - protein, 1390 aa, Homo sapiens; identical to SEQ ID NO: 76

SEQ ID NO: 7198 - protein, 512 aa, Homo sapiens; identical to SEQ ID NO: 5442

SEQ ID NO: 7199 - protein, 4493 aa, Homo sapiens; identical to SEQ ID NO: 835

SEQ ID NO: 7200 - protein, 273 aa, Homo sapiens; identical to SEQ ID NO: 2657

SEQ ID NO: 7201 - protein, 255 aa, Homo sapiens; identical to SEQ ID NO: 662

SEQ ID NO: 7202 - protein, 264 aa, Homo sapiens; identical to SEQ ID NO: 661

SEQ ID NO: 7203 - protein, 159 aa, Homo sapiens; identical to SEQ ID NO: 924

SEQ ID NO: 7204 - protein, 158 aa, Homo sapiens; identical to SEQ ID NO: 925

SEQ ID NO: 7205 - protein, 203 aa, Homo sapiens; identical to SEQ ID NO: 922

SEQ ID NO: 7206 - protein, 150 aa, Homo sapiens; identical to SEQ ID NO: 923

SEQ ID NO: 7207 - protein, 14507 aa, Homo sapiens; identical to SEQ ID NO: 5067

SEQ ID NO: 7208 - protein, 959 aa, Homo sapiens
FTTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSGKPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 7209 - protein, 848 aa, Homo sapiens; identical to SEQ ID NO: 173

SEQ ID NO: 7210 - protein, 858 aa, Homo sapiens; identical to SEQ ID NO: 6595

SEQ ID NO: 7211 - protein, 761 aa, Homo sapiens; identical to SEQ ID NO: 949

SEQ ID NO: 7212 - protein, 114 aa, Homo sapiens; identical to SEQ ID NO: 3340

SEQ ID NO: 7213 - protein, 750 aa, Homo sapiens; identical to SEQ ID NO: 3057

SEQ ID NO: 7214 - protein, 719 aa, Homo sapiens; identical to SEQ ID NO: 631

SEQ ID NO: 7215 - protein, 317 aa, Homo sapiens; identical to SEQ ID NO: 2871

SEQ ID NO: 7216 - protein, 244 aa, Homo sapiens; identical to SEQ ID NO: 5437

SEQ ID NO: 7217 - protein, 393 aa, Homo sapiens; identical to SEQ ID NO: 1070

SEQ ID NO: 7218 - protein, 937 aa, Homo sapiens; identical to SEQ ID NO: 3196

SEQ ID NO: 7219 - protein, 468 aa, Homo sapiens; identical to SEQ ID NO: 2911

SEQ ID NO: 7220 - protein, 411 aa, Homo sapiens; identical to SEQ ID NO: 5994

SEQ ID NO: 7221 - protein, 440 aa, Homo sapiens; identical to SEQ ID NO: 2910

SEQ ID NO: 7222 - protein, 1356 aa, Homo sapiens; identical to SEQ ID NO: 2607

SEQ ID NO: 7223 - protein, 500 aa, Homo sapiens
MQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 7224 - protein, 514 aa, Homo sapiens; identical to SEQ ID NO: 5031

SEQ ID NO: 7225 - protein, 497 aa, Homo sapiens; identical to SEQ ID NO: 111

SEQ ID NO: 7226 - protein, 517 aa, Homo sapiens; identical to SEQ ID NO: 5032

SEQ ID NO: 7227 - protein, 819 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTPGVQWCDISSLQPLTSRFQQFSCLSLPSTWDYRVKILFIRVP

SEQ ID NO: 7228 - protein, 801 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 7229 - protein, 825 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTSLSVAQPGVQWCDISSLQPLTSRFQQFSCLSLPSTWDYRVKILFIRVP

SEQ ID NO: 7230 - protein, 789 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTVSYKTSKKQSGL

SEQ ID NO: 7231 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 7232 - protein, 798 aa, Homo sapiens; identical to SEQ ID NO: 7231

SEQ ID NO: 7233 - protein, 788 aa, Homo sapiens; identical to SEQ ID NO: 64

SEQ ID NO: 7234 - protein, 216 aa, Homo sapiens
MGWIRGRRSRHSWEMSEFHNYNLDLKKSDFSTRWQKQRCPVVKSKCRENASPFFFCCFIAVAMGIRFIIMVTIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 7235 - protein, 361 aa, Homo sapiens; identical to SEQ ID NO: 43

SEQ ID NO: 7236 - protein, 361 aa, Homo sapiens; identical to SEQ ID NO: 43

SEQ ID NO: 7237 - protein, 361 aa, Homo sapiens; identical to SEQ ID NO: 43

SEQ ID NO: 7238 - protein, 361 aa, Homo sapiens; identical to SEQ ID NO: 43

SEQ ID NO: 7239 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 7240 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 7241 - protein, 2555 aa, Homo sapiens; identical to SEQ ID NO: 7240

SEQ ID NO: 7242 - protein, 2531 aa, Homo sapiens
MPRLLTPLLCLTLLPALAARGLRCSQPSGTCLNGGRCEVANGTEACVCSGAFVGQRCQDSNPCLSTPCKNAGTCHVVDHGGTVDYACSCPLGFSGPLCLTPLDNACLANPCRNGGTCDLLTLTEYKCRCPPGWSGKSCQQADPCASNPCANGGQCLPFESSYICRCPPGFHGPTCRQDVNECSQNPGLCRHGGTCHNEIGSYRCACRATHTGPHCELPYVPCSPSPCQNGGTCRPTGDTTHECACLPGFAGQNCEENVDDCPGNNCKNGGACVDGVNTYNCRCPPEWTGQYCTEDVDECQLMPNACQNGGTCHNTHGGYNCVCVNGWTGEDCSENIDDCASAACFQGATCHDRVASFYCECPHGRTGLLCHLNDACISNPCNEGSNCDTNPVNGKAICTCPSGYTGPACSQDVDECALGANPCEHAGKCLNTLGSFECQCLQGYTGPRCEIDVNECISNPCQNDATCLDQIGEFQCICMPGYEGVYCEINTDECASSPCLHNGHCMDKINEFQCQCPKGFNGHLCQYDVDECASTPCKNGAKCLDGPNTYTCVCTEGYTGTHCEVDIDECDPDPCHYGSCKDGVATFTCLCQPGYTGHHCETNINECHSQPCRHGGTCQDRDNSYLCLCLKGTTGPNCEINLDDCASNPCDSGTCLDKIDGYECACEPGYTGSMCNVNIDECAGSPCHNGGTCEDGIAGFTCRCPEGYHDPTCLSEVNECNSNPCIHGACRDGLNGYKCDCAPGWSGTNCDINNNECESNPCVNGGTCKDMTSGYVCTCREGFSGPNCQTNINECASNPCLNQGTCIDDVAGYKCNCPLPYTGATCEVVLAPCATSPCKNSGVCKESEDYESFSCVCPTGWQGQTCEVDINECVKSPCRHGASCQNTNGSYRCLCQAGYTGRNCESDIDDCRPNPCHNGGSCTDGINTAFCDCLPGFQGAFCEEDINECASNPCQNGANCTDCVDSYTCTCPVGFNGIHCENNTPDCTESSCFNGGTCVDGINSFTCLCPPGFTGSYCQYDVNECDSRPCLHGGTCQDSYGTYKCTCPQGYTGLNCQNLVRWCDSAPCKNGGRCWQTNTQYHCECRSGWTGVNCDVLSVSCEVAAQKRGIDVTLLCQHGGLCVDEGDKHYCHCQAGYTGSYCEDEVDECSPNPCQNGATCTDYLGGFSCKCVAGYHGSNCSEEINECLSQPCQNGGTCIDLTNSYKCSCPRGTQGVHCEINVDDCHPPLDPASRSPKCFNNGTCVDQVGGYTCTCPPGFVGERCEGDVNECLSNPCDPRGTQNCVQRVNDFHCECRAGHTGRRCESVINGCRGKPCKNGGVCAVASNTARGFICRCPAGFEGATCENDARTCGSLRCLNGGTCISGPRSPTCLCLGSFTGPECQFPASSPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLSDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGTALGGTPTLSPTLCSPNGYLGNLKSATQGKKARKPSTKGLACGSKEAKDLKARRKKSQDGKGCLLDSSSMLSPVDSLESPHGYLSDVASPPLLPSPFQQSPSMPLSHLPGMPDTHLGISHLNVAAKPEMAALAGGSRLAFEPPPPRLSHLPVASSASTVLSTNGTGAMNFTVGAPASLNGQCEWLPRLQNGMVPSQYNPLRPGVTPGTLSTQAAGLQHSMMGPLHSSLSTNTLSPIIYQGLPNTRLATQPHLVQTQQVQPQNLQLQPQNLQPPSQPHLSVSSAANGHLGRSFLSGEPSQADVQPLGPSSLPVHTILPQESQALPTSLPSSMVPPMTTTQFLTPPSQHSYSSSPVDNTPSHQLQVPEHPFLTPSPESPDQWSSSSPHSNISDWSEGISSPPTTMPSQITHIPEAFK

SEQ ID NO: 7243 - protein, 2900 aa, Homo sapiens
MTPVCTPTRPGPCAHPALPRSTPHSITDSSRAEPIESFLVLSPALELRLLLAVVGQDTPLGDVWAGGKASGGGDTEGPLSEGSKEGEAATGPQAPGAEWHAPPRSTCLSSTPRPEAVPPSLPCRSPGWGACGGRRPGPALEPAHMGSVPSQQRPPGLDRSREDNGPPQPLPSPHGGASLAPAPPPACRGWQPPLRWPGAAAARVPGHRRTCSPAALCPCCRCLIYWARFSSHCNSRSLPGQDALGPGLWVPSATQAGTRQPVTGSTLSGGHATFPRLQGMALPEPEGEGPPTTSAQGCGPSVRAAFPGRCQLGAVGAFHPRGSAAGKREAWLVPEPLLGFPSSSRLRGDPGGHVPPRLKKPRQQVAKGGPGAGVAGAEPFPVGSAGDQAWGWAGGKAPPTPGSPATVAAREPAQGLPDCGGAFAGQQCQAPNPCLSAPCKNGGTCHTTEREGLVDYVCGCRLGFSGPLCLTPRDHACLASPCLNGGTCDLLTLTEYKCLCTPGWSGKTCQQADPCASNPCANGGQCLPFEASYICHCPPGFHGPTCRQDVNECSQSPGLCHHGGTCLNEVGSYRCVCRPTHTGPHCELPYVPCSPSPCQNGGTCRPTGDTTHECACLPGFTGQNCEENIDDCPGNSCKNGGACVDGVNTYNCRCPPEWTGQYCTEDVDECQLMPNACQNGGTCHNTHGGYNCVCVNGWTGEDCSENIDDCASASCFQGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGLHCEVNTDECASSPCLQNGRCLDKINEFVCECPTGFTGHLCQYDVDECASTPCKNGAKCLDGPNTYTCVCTEGYTGPHCEVDIDECDPDPCHYGSCKDGVATFTCLCQPGYTGHHCESNINECHSQPCRHGGTCQDRDNAYLCFCLKGTTGPNCEINLDDCASNPCDSGTCLDKIDGYECACEPGYTGSMCNINIDECADSPCHNGGTCEDGINGFTCRCPEGYHDPTCLSEVNECSSNPCIHGACRDSLNGYKCDCDPGWSGANCDVNNDECESNPCINGGTCKDMTSGYVCACREGFSGPNCQTNINECASNPCLNQGTCIDDVAGYKCNCLLPYTGATCEVVLAPCAPGPCRNGGECRESEDYESFSCACPAGWQGQTCEIDINECVKSPCRAGASCQNTNGSYRCHCQAGYTGRNCETDIDDCRPNPCHNGGSCTDGINTAFCDCLPGFQGAFCEEDINECASSPCRNGANCTDCVDSYTCTCPTGFSGIHCENNTPDCTESSCFNGGTCVDGINSFTCLCPPGFTGSYCQHDVNECDSRPCLHGGTCHDSYGTYTCTCPQGYTGLNCQTLVRWCDSSPCKNDGRCWQTNALYRCECHSGWTGLYCDVPSVSCEVAARQQGVNVTHLCRNGGLCMNAGNTHRCHCQAGYTGSYCEEQVDECSPSPCQNGATCTDYPGGYSCECVAGYHGVNCSEEVNECLSQPCRNGGTCIDLTNTYKCSCPRGTQGVHCEINVDDCNPPIDPVSRGPKCFNNGTCVDQVGGYSCSCPPGFVGERCEGDVNECLSNPCDARGTQNCVQHVNAFHCECRAGHTGRRCESVINGCKDRPCKNGGSCAVASNTARGFICKCPAGFEGATCENDARSCGSLRCLNGGTCIAGPRSPTCLCLGPFTGPECQFPASSPCVGGNPCYNQGVCEPTAESPFYRCRCPAKFNGLLCHILDYSFGGGVGLDIPPPQIEETCELPGCREEAGNKVCSLQCNSHACGWDGGDCSLDFDDPWQNCTQSLQCWKYFSNGRCDSQCNSAGCLFDGFDCQRAEGQCNPLYDQYCKDHFRDGHCDQGCNSAECEWDGLDCAEHVPERLAAGTLVLVVLMPPEQLRNRSLHFLRELSRLLHTNVVFKRDASGQQMIFPYYGRAPLPAGERSEECRCEHHACPAGAGQGEPSGPLCTSRSIVYLEIDNRQCVQSSSQCFQSATDVAAFLGALASLGSLNIPYKIEAVQSETVEPPPPPPLHFMYVAVVAFVLLFFVGCGVLLSRKRRRQHGQLWFPEGFKVSEASKKKRREPLGEDSVGLKPLKNSSDGALMDDNQNEWGDEGLEAKKFRFEEPVVLPDLDDQTDHRQWTQQHLDAADLRVSAMAPTPPQGEADADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYSLVRSPPLHGATLGGTPTLSPPLCSPNGYLGNLKPPMQGKKARKPSTKGLACGGKEPKDLKARRKKSQDGKGCLLDSGSVMSPVDSLESPHGYLSDVASPPLLPSPFQPSPSVPLNHLPGMPETHLGVSHLSVAAKPEMAVLSGGSRLAFEAGPPRLSHLPVASSTSTILGSGGSGGSGAVNFTVGGAAGLNGQCEWLSRLQNGLVPNQYNPLRGGVTPGTLSTQAAGLQHGTVGPLHAPALSQVMTYQALPSTRLASQPHLVQPQQNLQMQPPSMPPQPNLQPHLGVSSAASGHLGRSFLGGELSQADMQPLGPGNLAAHTVLPQDGQVLPTSLPSTLAPPTMAPPMTTAQFLTPPSQHSYSSSPVDNTPSHQLQVPEHPFLTPSPESPDQWSSSSPHSNISDWSEGISSPPTSVPSQIAHVPEAFK

SEQ ID NO: 7244 - protein, 2561 aa, Homo sapiens
MGRCSAAHPRGGVHCPGLCAVPDALLLFPGVRCTQLAESCLNGGKCETFLNGTEVCQCSSAHMGERCQLPNPCLSSPCKNAGTCIPLLRGSTADYTCVCRLGFTDELCLTPLDNACLNNPCRNGGTCDLVTLSEYKCRCPPGWSGKTCQQADPCASNPCANGGQCVPFEAHYICRCTAGFHGANCKQDVNECNISPPVCKNGGSCTNEVGTYQCSCKPAYTGQNCEHLYVPCNPSPCQNGGTCRQTGDTTYDCTCLPGFTGQNCEENIDDCPGNNCRNGGTCVDGVNTYNCQCPPEWTGQYCTEDVDECQLMPNACQNGGTCHNNHGGYNCVCVNGWTGEDCSENIDDCAMAACFQGATCHDRVASFYCECPHGRTGLLCHLDDACISNPCNEGSNCDTNPVNGKAICTCPSGYMGPACNQDVDECSLGANPCEHAGKCINTQGSFQCQCLQGYSGPRCEIDVNECLSNPCQNDATCLDQIGEFQCICMPGYEGVYCEINTDECASSPCLHNGNCLDKINEFHCECPTGFNGHLCQFDIDECASTPCKNGAKCVDGPNTYSCECTEGFSGVHCEIDIDECNPDPCHYGTCKDSIAAFTCLCQPGYTGHRCDININECQSQPCRNGGTCQDRDNAYNCLCLKGTTGPNCEINLDDCASNPCDYGKCIDKINGYECTCEPGYTGRMCNINIDECASNPCHNGGTCKDGINGFTCLCPEGFHDPKCLSEVNECNSNPCIHGRCHDGLNGYRCDCDPGWSGTNCDINNNECESNPCMNGGTCKDMTSGYICTCREGFSGPNCQTNINECASNPCLNQGTCIDDVAGYTCNCLLPYTGATCEDVLAPCAGGPCKNGGECRESEDYKRFSCSCPPGWQGQTCEIDINECVKSPCRNGATCQNTNGSYRCLCRVGFAGRNCDTDIDDCQPNPCHNGGSCSDGIGTFFCECLAGFRGLKCEEDINECASNPCKNGANCTDCVNSYTCTCPSGFSGIHCENNTPDCTESSCFNGGTCVDGINTFTCLCPSGFTGSYCEHNINECDSKPCLNGGTCQDSYGTYKCTCPQGYTGLNCQNLVRWCDSSPCKNGGKCWQTNNLYRCECNSGWTGLYCDVPSVSCEVAAKQQGIDVAHLCRNSGLCVDSGNTHFCRCQAGYTGSYCEEQVDECSPNPCQNGATCTDYLGGYSCECVAGYHGVNCSEEINECLSHPCQNGGTCIDLINTYKCSCPRGTQGVHCEINVDDCSPFFDPVTLGPKCFNNGKCTDRVGGYSCICPPGFVGERCEGDVNECLSNPCDARGTQNCVQRVNDYKCECRPGYAGRRCDTVVDGCKGKPCRNGGTCAVASNTGRGFICKCPPGFVGATCENDSHTCGTLHCLNGGTCISMHKSSKCVCAAAFTGPECQYPASSPCISNPCYNGGTCEFLSDASPYYHCNCPANFNGLNCHILDFDFQGGFGQDIIPPKIEEKCEIAVCASYAGNKICDGKCNNHACGWDGGDCSLNFNDPWKNCSQSLQCWKYFNDGKCDSQCNNAGCLYDGFDCQKYEGQCNPLYDQYCKDHFSDGHCDQGCNNFECEWDGLDCANNMPEKLADGTLVVVVLITPENLKNNSFNFLRELSRVLHTNVVFKKNAKGEYMIFPYYGNEEELKKHYIKRSTEDWADMSSAVINKVKSSLYSRAGRRQKRELDQMDIRGSIVYLEIDNRQCIQSSSQCFQSATDVAAFLGALASLGNLNIPYKIEAVKSETAEPARNSQLYPMYVVVAALVLLAFIGVGVLVSRKRRREHGQLWFPEGFKVTESSKKKRREPLGEDSVGLKPLKNASDGTLMDDNQNEWGDEETLDTKKFRFEEQAMLPDTDDQTDHRQWTQQHLDAADLRISSMAPTPPQGEIDADCMDVNVRGPDGFTPLMIASCSGGGLETGNSEEEDDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINCHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYNLVRSPPLHSGPLGAPTLSPPLCSPSSYIGNLKPAVQGKKARKPSTKGLSCNGKDSKDLKARRKKSQDGKGCLLDNSSVLSPVDSLESPHGYLSDVASPPLMTSPFQQSPSMPLNHLPGMPDAHMSINHLNMAGKQEMALGGSGRMAFEAVPPRLSHLPVSSPSTAMSNAPMNFSVGGAAGLSGQCDWLSRLQSGMVQNQYGAMRGGMQPGTHQQAQNLQHGMMSSLHNGLPSTSLSQMMSYQAMPSTRLASQPHLLQNQQMQQMQQPGMQPQPGMQPQPGMQQPQQQPQQQPQPQQHHNPGSNASGHMGQNFLGTELSQPDMQPVSSSAMAVHTILPQDSQLLPTSLPSSLAQPMTTTQFLTPPSQHSYSSPLDNTPSHQLQVPDHPFLTPSPESPDQWSSSSPHSNVSDWSEGISSPPTSMQSQMGHIPEAFK

SEQ ID NO: 7245 - protein, 2531 aa, Homo sapiens
MPRLLAPLLCLTLLPALAARGLRCSQPSGTCLNGGRCEVANGTEACVCSGAFVGQRCQDPSPCLSTPCKNAGTCYVVDHGGIVDYACSCPLGFSGPLCLTPLANACLANPCRNGGTCDLLTLTEYKCRCPPGWSGKSCQQADPCASNPCANGGQCLPFESSYICGCPPGFHGPTCRQDVNECSQNPGLCRHGGTCHNEIGSYRCACRATHTGPHCELPYVPCSPSPCQNGGTCRPTGDTTHECACLPGFAGQNCEENVDDCPGNNCKNGGACVDGVNTYNCRCPPEWTGQYCTEDVDECQLMPNACQNAGTCHNSHGGYNCVCVNGWTGEDCSDNIDDCASAACFQGATCHDRVASFYCECPHGRTGLLCHLNDACISNPCNEGSNCDTNPVNGKAICTCPRGYTGPACSQDVDECALGANPCEHAGKCLNTLGSFECQCLQGYTGPRCEIDVNECISNPCQNDATCLDQIGEFQCICMPGYEGVYCEINTDECASSPCLHNGRCVDKINEFLCQCPKGFSGHLCQYDVDECASTPCKNGAKCLDGPNTYTCVCTEGYTGTHCEVDIDECDPDPCHIGLCKDGVATFTCLCQPGYTGHHCETNINECHSQPCRHGGTCQDRDNYYLCLCLKGTTGPNCEINLDDCASNPCDSGTCLDKIDGYECACEPGYTGSMCNVNIDECAGSPCHNGGTCEDGIAGFTCRCPEGYHDPTCLSEVNECNSNPCIHGACRDGLNGYKCDCAPGWSGTNCDINNNECESNPCVNGGTCKDMTSGYVCTCREGFSGPNCQTNINECASNPCLNQGTCIDDVAGYKCNCPLPYTGATCEVVLAPCATSPCKNSGVCKESEDYESFSCVCPTGWQGQTCEIDINECVKSPCRHGASCQNTNGSYRCLCQAGYTGRNCESDIDDCRPNPCHNGGSCTDGVNAAFCDCLPGFQGAFCEEDINECATNPCQNGANCTDCVDSYTCTCPTGFNGIHCENNTPDCTESSCFNGGTCVDGINSFTCLCPPGFTGSYCQYDVNECDSRPCLHGGTCQDSYGTYKCTCPQGYTGLNCQNLVRWCDSAPCKNGGKCWQTNTQYHCECRSGWTGFNCDVLSVSCEVAAQKRGIDVTLLCQHGGLCVDEEDKHYCHCQAGYTGSYCEDEVDECSPNPCQNGATCTDYLGGFSCKCVAGYHGSNCSEEINECLSQPCQNGGTCIDLTNTYKCSCPRGTQGVHCEINVDDCHPPLDPASRSPKCFNNGTCVDQVGGYTCTCPPGFVGERCEGDVNECLSNPCDPRGTQNCVQRVNDFHCECRAGHTGRRCESVINGCRGKPCRNGGVCAVASNTARGFICRCPARFEGATCENDARTCGSLRCLNGGTCISGPRSPTCLCLGSFTGPECQFPASSPCVGSNPCYNQGTCEPTSESPFYRCLCPAKFNGLLCHILDYSFTGAAGRDIPPPQIEEACELPECQEDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRDVSHVLHTNVVFKRDAQGQQMIFPYYGREEELRKHPIKRSAVGWATTSLLPGTNGGRQRRELDPMDIHGSIVYLEIDNRQCVQSSSQCFQSATDVAAFLGALASLGSLNIPYKIEAVKSETVEPPLPSQLHLMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRVSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGTALGGTPTLSPTLCSPNGYLGNLKSATQGKKARKPSTKGLACSSKEAKDLKARRKKSQDGKGCLLDSSSMLSPVDSLESPHGYLSDVASPPLLPSPFQQSPSMPLSHLPGMPDTHLGISHLNVAAKPEMAALAGGSRLAFEPPPPRLSHLPVASSASTVLSTNGTGAMNFTVGAPASLNGQCEWLPRLQNGMVPSQYNPLRPGVTPGTLSTQAAGLQHGMMGPIHSSLSTNTLSPIIYQGLPNTRLATQPHLVQTQQVQPQNLQIQPQNLQPPSQPHLSVSSAANGHLGRSFLSGEPSQADVQPLGPSSLPVHTILPQESQALPTSLPSSMVPPMTTTQFLTPPSQHSYSSSPVDNTPSHQLQVPEHPFLTPSPESPDQWSSSSRHSNISDWSEGISSPPTSMPSQITHIPEAFK

SEQ ID NO: 7246 - protein, 306 aa, Artificial Sequence
  synthetic amino acid sequence
PPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 7247 - protein, 358 aa, Artificial Sequence
  synthetic amino acid sequence
PCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 7248 - protein, 37 aa, Artificial Sequence
  synthetic amino acid sequence
PCVGSNPCYNQGTCEPTSENPFYRCLCPAKFNGLLCH

SEQ ID NO: 7249 - protein, 37 aa, Artificial Sequence
  synthetic amino acid sequence
PCLGGNPCYNQGTCEPTSESPFYRCLCPAKFNGLLCH

SEQ ID NO: 7250 - protein, 4 aa, Artificial Sequence
  synthetic amino acid sequence
VLLS

SEQ ID NO: 7251 - protein, 5 aa, Artificial Sequence
  synthetic amino acid sequence
GVLLS

SEQ ID NO: 7252 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 7253 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 7254 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 7255 - protein, 303 aa, Homo sapiens
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 7256 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 7257 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 7258 - protein, 180 aa, Homo sapiens; identical to SEQ ID NO: 7182

SEQ ID NO: 7259 - protein, 647 aa, Homo sapiens
MAEEEAPKKSRAAGGGASWELCAGALSARLAEEGSGDAGGRRRPPVDPRRLARQLLLLLWLLEAPLLLGVRAQAAGQGPGQGPGPGQQPPPPPQQQQSGQQYNGERGISVPDHGYCQPISIPLCTDIAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNPQHGGGGHRGGFPGGAGASERGKFSCPRALKVPSYLNYHFLGEKDCGAPCEPTKVYGLMYFGPEELRFSRTWIGIWSVLCCASTLFTVLTYLVDMRRFSYPERPIIFLSGCYTAVAVAYIAGFLLEDRVVCNDKFAEDGARTVAQGTKKEGCTILFMMLYFFSMASSIWWVILSLTWFLAAGMKWGHEAIEANSQYFHLAAWAVPAIKTITILALGQVDGDVLSGVCFVGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 7260 - protein, 365 aa, Homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 7261 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 7262 - protein, 381 aa, Homo sapiens
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 7263 - protein, 386 aa, Homo sapiens [sequence omitted]

SEQ ID NO: 7264 - protein, 97 aa, Homo sapiens
MPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 7265 - protein, 248 aa, Homo sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRREKKFFLLEPQMKVAALRAGAQQGLSRASAELWTPDSEPTPRPLALVFKPSPLGALELLSPQPLFPYAADP

SEQ ID NO: 7266 - protein, 116 aa, Homo sapiens
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 7267 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 7268 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 7269 - protein, 43 aa, Homo sapiens
MAARAVFLALSAQLLQARLMKEESPVVSWRLEPEDGTALCFIF

SEQ ID NO: 7270 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7271 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 7272 - protein, 524 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 7273 - protein, 489 aa, Homo sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 7274 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 7275 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 7276 - protein, 636 aa, Homo sapiens
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 7277 - protein, 582 aa, Homo sapiens
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 7278 - protein, 420 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 7279 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 7280 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 7281 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 7282 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 7283 - protein, 351 aa, Homo sapiens
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 7284 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 7285 - protein, 299 aa, Homo sapiens
MLRLFYFSAIIASVILNFVGIIMNLFITVVNCKTWVKSHRISSSDRILFSLGITRFLMLGLFLVNTIYFVSSNTERSVYLSAFFVLCFMFLDSSSVWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 7286 - protein, 798 aa, Homo sapiens
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFT

SEQ ID NO: 7287 - protein, 795 aa, Homo sapiens
MKKLGRIHPNRQVLAFILMVFLSQVRLEPIRYSVLEETESGSFVAHLAKDLGLGIGELASRSARVLSDDDKQRLQLDRQTGDLLLREKLDREELCGPIEPCVLHFQVFLEMPVQFFQGELLIQDINDHSPIFPEREVLLKILENSQPGTLFPLLIAEDLDVGSNGLQKYTISPNSHFHILTRNHSEGKKYPDLVQDKPLDREEQPEFSLTLVALDGGSPPRSGTVMVRILIMDINDNAPEFVHTPYGVQVLENSPLDSPIVRVLARDIDAGNFGSVSYGLFQASDEIKQTFSINEVTGEILLKKKLDFEKIKSYHVEIEATDGGGLSGKGTVVIEVVDVNDNPPELIISSLTSSIPENAPETVVSIFRIRDRDSGENGKMICSIPDNLPFILKPTLKNFYTLVTERPLDRETSAEYNITIAVTDLGTPRLKTQQNITVQVSDVNDNAPAFTQTSYTLFVRENNSPALHIGSVSATDRDSGTNAQVTYSLLPPQDPHLPLASLVSINADNGHLFALRSLDYEALQAFEFRVGASDRGSPALSSEALVRVLVLDTNDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGDSGTGEFKFLKPIFPNLLVQDTGREVKENPKFRNSLVFS

SEQ ID NO: 7288 - protein, 630 aa, Homo sapiens
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 7289 - protein, 353 aa, Homo sapiens
MVGDTLKLLSPLMTRYFFLLFYSTDSSDLNENQHPLDFDEMAFGKVKSGISFLIQTGVGILGNSFLLCFYNLILFTGHKLRPTDLILSQLALANSMVLFFKGIPQTMAAFGLKYLLNDTGCKFVFYYHRVGTRVSLSTICLLNGFQAIKLNPSICRWMEIKIRSPRFIDFCCLLCWAPHVLMNASVLLLVNGPLNSKNSSAKNNYGYCSYKASKRFSSLHAVLYFSPDFMSLGFMVWASGSMVFFLYRHKQQVQHNHSNRLSCRPSQEARATHTIMVLVSSFFVFYSVHSFLTIWTTVVANPGQWIVTNSVLVASCFPARSPFVLIMSDTHISQFCFACRTRKTLFPNLVVMP

SEQ ID NO: 7290 - protein, 670 aa, Homo sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 7291 - protein, 540 aa, Homo sapiens
MWLLRCVLLCVSLSLAVSGQHKPEAPDYSSVLHCGPWSFQFAVNLNQEATSPPVLIAWDNQGLLHELQNDSDCGTWIRKGPGSSVVLEATYSSCYVTEWDSHYIMPVGVEGAGAAEHKVVTERKLLKCPMDLLARDAPDTDWCDSIPARDRLPCAPSPISRGDCEGLGCCYSSEEVNSCYYGNTVTLHCTREGHFSIAVSRNVTSPPLLLDSVRLALRNDSACNPVMATQAFVLFQFPFTSCGTTRQITGDRAVYENELVATRDVKNGSRGSVTRDSIFRLHVSCSYSVSSNSLPINVQVFTLPPPFPETQPGPLTLELQIAKDKNYGSYYGVGDYPVVKLLRDPIYVEVSILHRTDPYLGLLLQQCWATPSTDPLSQPQWPILVKGCPYIGDNYQTQLIPVQKALDLPFPSHHQRFSIFTFSFVNPTVEKQALRGPVHLHCSVSVCQPAETPSCVVTCPDLSRRRNFDNSSQNTTASVSSKGPMILLQATKDPPEKLRVPVDSKVLWVAGLSGTLILGALLVSYLAVKKQKSCPDQMCQ

SEQ ID NO: 7292 - protein, 798 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 7293 - protein, 929 aa, Homo sapiens
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFYLVVALALISVLFLLAVILAIALRLRQSFSPTAGDCFESVLCSKSGPVGPPNYSEGTLPYAYNFCVPGDQMNPEFNFFTSVDHCPATQDNLNKDSMLLASILTPSVEADKKILKQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 7294 - protein, 568 aa, Homo sapiens
MMGCWILNEGLSTILVLSWLGINFYLFIDTFYWYEEEESFHYTRVILGSTLAWARASALCLNFNCMLILIPVSRNLISFIRGTSICCRGPWRRQLDKNLRFHKLVAYGIAVNATIHIVAHFFNLERYHWSQSEEAQGLLAALSKLGNTPNESYLNPVRTFPTNTTTELLRTIAGVTGLVISLALVLIMTSSTEFIRQASYELFWYTHHVFIVFFLSLAIHGTGRIVRGQTQDSLSLHNITFCRDRYAEWQTVAQCPVPQFSGKEPSAWKWILGPVVLYACERIIRFWRFQQEVVITKVVSHPSGVLELHMKKRGFKMAPGQYILVQCPAISSLEWHPFTLTSAPQEDFFSVHIRAAGDWTAALLEAFGAEGQALQEPWSLPRLAVDGPFGTALTDVFHYPVCVCVAAGIGVTPFAALLKSIWYKCSEAQTPLKLSKVYFYWICRDARAFEWFADLLLSLETRMSEQGKTHFLSYHIFLTGWDENQALHIALHWDENTDVITGLKQKTFYGRPNWNNEFKQIAYNHPSSSIGVFFCGPKALSRTLQKMCHLYSSADPRGVHFYYNKESF

SEQ ID NO: 7295 - protein, 430 aa, Homo sapiens
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 7296 - protein, 651 aa, Homo sapiens
MGDLSSLTPGGSMGLQVNRGSQSSLEGAPATAPEPHSLGILHASYSVSHRVRPWWDITSCRQQWTRQILKDVSLYVESGQIMCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPKVMLFDEPTTGLDCMTANQIVVLLVELARRNRIVVLTIHQPRSELFQLFDKIAILSFGELIFCGTPAEMLDFFNDCGYPCPEHSNPFDFYMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 7297 - protein, 307 aa, Homo sapiens
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKTKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 7298 - protein, 244 aa, Homo sapiens
MAAAASPAILPRLAILPYLLFDWSGTGRADAHSLWYNFTIIHLPRHGQQWCEVQSQVDQKNFLSYDCGSDKVLSMGHLEEQLYATDAWGKQLEMLREVGQRLRLELADTELEDFTPSGPLTLQVRMSCECEADGYIRGSWQFSFDGRKFLLFDSNNRKWTVVHAGARRMKEKWEKDSGLTTFFKMVSMRDCKSWLRDFLMHRKKRLEPTAPPTMAPGLAQPKAIATTLSPWSFLIILCFILPGI

SEQ ID NO: 7299 - protein, 373 aa, Homo sapiens
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 7300 - protein, 496 aa, Homo sapiens
MDCYRTSLSSSWIYPTVILCLFGFFSMMRPSEPFLIPYLSGPDKNLTSAEITNEIFPVWTYSYLVLLLPVFVLTDYVRYKPVIILQGISFIITWLLLLFGQGVKTMQVVEFFYGMVTAAEVAYYAYIYSVVSPEHYQRVSGYCRSVTLAAYTAGSVLAQLLVSLANMSYFYLNVISLASVSVAFLFSLFLPMPKKSMFFHAKPSREIKKSSSVNPVLEETHEGEAPGCEEQKPTSEILSTSGKLNKGQLNSLKPSNVTVDVFVQWFQDLKECYSSKRLFYWSLWWAFATAGFNQVLNYVQILWDYKAPSQDSSIYNGAVEAIATFGGAVAAFAVGYVKVNWDLLGELALVVFSVVNAGSLFLMHYTANIWACYAGYLIFKSSYMLLITIAVFQIAVNLNVERYALVFGINTFIALVIQTIMTVIVVDQRGLNLPVSIQFLVYGSYFAVIAGIFLMRSMYITYSTKSQKDVQSPAPSENPDVSHPEEESNIIMSTKL

SEQ ID NO: 7301 - protein, 201 aa, Homo sapiens
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 7302 - protein, 333 aa, Homo sapiens
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 7303 - protein, 1069 aa, Homo sapiens
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQMRLHPYITVFG

SEQ ID NO: 7304 - protein, 183 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAADKPRGFARGLDPERIIGATDSSGELMFLMKWKDSDEADLVLAKEANMKCPQIVIAFYEERLTWHSCPEDEAQ

SEQ ID NO: 7305 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 7306 - protein, 455 aa, Homo sapiens
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 7307 - protein, 362 aa, Homo sapiens
MVWPWVAMASRWGPLIGLAPCCLWLLGAVLLMDASARPANHSSTRERVANREENEILPPDHLNGVKLEMDGHLNRGFHQEVFLGKDLGGFDEDAEPRRSRRKLMVIFSKVDVNTDRKISAKEMQRWIMEKTAEHFQEAMEESKTHFRAVDPDGDGHVSWDEYKVKFLASKGHSEKEVADAIRLNEELKVDEETQEVLENLKDRWYQADSPPADLLLTEEEFLSFLHPEHSRGMLRFMVKEIVRDLDQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 7308 - protein, 211 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 7309 - protein, 798 aa, Homo sapiens; identical to SEQ ID NO: 7231

SEQ ID NO: 7310 - protein, 798 aa, Homo sapiens; identical to SEQ ID NO: 7231

SEQ ID NO: 7311 - protein, 700 aa, Homo sapiens
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRKNPHQVDLRTARVFLEVAELHRKHLGGQLLFGPDGFLYIILGDGMITLDDMEEMDGLSDFTGSVLRLDVDTDMCNVPYSIPRSNPHFNSTNQPPEVFAHGLHDPGRCAVDRHPTDININLTILCSDSNGKNRSSARILQIIKGKDYESEPSLLEFKPFSNGPLVGGFVYRGCQSERLYGSYVFGDRNGNFLTLQQSPVTKQWQEKPLCLGTSGSCRGYFSGHILGFGEDELGEVYILSSSKSMTQTHNGKLYKIVDPKRPLMPEECRATVQPAQTLTSECSRLCRNGYCTPTGKCCCSPGWEGDFCRTAKCEPACRHGGVCVRPNKCLCKKGYLGPQCEQVDRNIRRVTRAGILDQIIDMTSYLLDLTSYIV

SEQ ID NO: 7312 - protein, 180 aa, Homo sapiens; identical to SEQ ID NO: 7182

SEQ ID NO: 7313 - protein, 501 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 7314 - protein, 323 aa, Homo sapiens
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 7315 - protein, 243 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 7316 - protein, 301 aa, Homo sapiens
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFSAGNGWWWVPVVAPLVGATVGTATYQLLVALHHPEGPEPAQDLVSAQHKASELETPASAQMLECKL

SEQ ID NO: 7317 - protein, 386 aa, Homo sapiens
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCL

SEQ ID NO: 7318 - protein, 232 aa, Homo sapiens
MANYYEVLGVQASASPEDIKKAYRKLALRWHPDKNPDNKEEAEKKFKLVSEAYEVLSDSKKRSLYDRAGCDSWRAGGGASTPYHSPFDTGYTFRNPEDIFREFFGGLDPFSFEFWDSPFNSDRGGRGHGLRGAFSAGFGEFPAFMEAFSSFNMLGCSGGSHTTFSSTSFGGSSSGSSGFKSVMSSTEMINGHKVTTKRIVENGQERVEVEEDGQLKSVTVNGKEQLKWMDSK

SEQ ID NO: 7319 - protein, 365 aa, Homo sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 7320 - protein, 1401 aa, Homo sapiens
MDGDSSSSSGGSGPAPGPGPEGEQRPEGEPLAPDGGSPDSTQTKAVPPEASPERSCSLHSCPLEDPSSSSGPPPTTSTLQPVGPSSPLAPAHFTYPRALQEYQGGSSLPGLGDRAALCSHGSSLSPSPAPSQRDGTWKPPAVQHHVVSVRQERAFQMPKSYSQLIAEWPVAVLMLCLAVIFLCTLAGLLGARLPDFSKPLLGFEPRDTDIGSKLVVWRALQALTGPRKLLFLSPDLELNSSSSHNTLRPAPRGSAQESAVRPRRMVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 7321 - protein, 284 aa, Homo sapiens
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGQVRQLEEQLRIMDQTLKALMAAEDKYSQKEDRYEEEIKVLSDKLKEAETRAEFAERSVTKLEKSIDDLEDELYAQKLKYKAISEELDHALNDMTSM

SEQ ID NO: 7322 - protein, 815 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 7323 - protein, 397 aa, Homo sapiens
MNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFRFAKYYKMENGSEYRTLLKAFGIRFDVLVYGNAGKFNIIPTIISSVAAFTSVGVGTVLCDIILLNFLKGADQYKAKKFEEVNETTLKIAALTNPVYPSDQTTAEKQSTDSGAFSIGH

SEQ ID NO: 7324 - protein, 2015 aa, Homo sapiens [sequence omitted]

SEQ ID NO: 7325 - protein, 835 aa, Homo sapiens
MWLLALCLVGLAGAQRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPAGAPGTRRPPPPATLPPEPEPEPGPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYTLALRRAPDDVPLLAPGALTLLPSGLGPPPPPPPPSLHPFGPFPPPPPTATSHNNTLPHPHSTTRV

SEQ ID NO: 7326 - protein, 389 aa, Homo sapiens
MEGALAANWSAEAANASAAPPGAEGNRTAGPPRRNEALARVEVAVLCLILLLALSGNACVLLALRTTRQKHSRLFFFMKHLSIADLVVAVFQVLPQLLWDITFRFYGPDLLCRLVKYLQVVGMFASTYLLLLMSLDRCLAICQPLRSLRRRTDRLAVLATWLGCLVASAPQVHIFSLREVADGVFDCWAVFIQPWGPKAYITWITLAVYIVPVIVLAACYGLISFKIWQNLRLKTAAAAAAEAPEGAAAGDGGRVALARVSSVKLISKAKIRTVKMTFIIVLAFIVCWTPFFFVQMWSVWDANAPKEASAFIIVMLLASLNSCCNPWIYMLFTGHLFHELVQRFLCCSASYLKGRRLGETSASKKSNSSSFVLSHRSSSQRSCSQPSTA

SEQ ID NO: 7327 - protein, 837 aa, Homo sapiens
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 7328 - protein, 337 aa, Homo sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 7329 - protein, 327 aa, Homo sapiens
MEWRNHSGRVSEFVLLGFPAPAPLQVLLFALLLLAYVLVLTENTLIIMAIRNHSTLHKPMYFFLANMSFLEIWYVTVTIPKMLAGFVGSKQDHGQLISFEGCMTQLYFFLGLGCTECVLLAVMAYDRYMAICYPLHYPVIVSGRLCVQMAAGSWAGGFGISMVKVFLISGLSYCGPNIINHFFCDVSPLLNLSCTDMSTAELTDFILAIFILLGPLSVTGASYVAITGAVMHIPSAAGRYKAFSTCASHLTVVIIFYAASIFIYARPKALSAFDTNKLVSVLYAVIVPLLNPIIYCLRNQEVKRALCCTLHLYQHQDPDPKKASRNV

SEQ ID NO: 7330 - protein, 301 aa, Homo sapiens
MHPEPAPPPSRSSPELPPSGGSTTSGSRRSRRRSGDGEPPGAPPPPPSAVTYPDWIGQSYSEVMSLNEHSMQALSWRKLYLSRAKLKASSRTSALLSGFAMVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 7331 - protein, 473 aa, Homo sapiens
MALKDTGSGGSTILPISEMVSSSSSPGASAAAAPGPCAPSPFPEVVELNVGGQVYVTKHSTLLSVPDSTLASMFSPSSPRGGARRRGELPRDSRARFFIDRDGFLFRYVLDYLRDKQLALPEHFPEKERLLREAEYFQLTDLVKLLSPKVTKQNSLNDEGCQSDLEDNVSQGSSDALLLRGAAAAVPSGPGAHGGGGGGGAQDKRSGFLTLGYRGSYTTVRDNQADAKFRRVARIMVCGRIALAKEVFGDTLNESRDPDRQPEKYTSRFYLKFTYLEQAFDRLSEAGFHMVACNSSGTAAFVNQYRDDKIWSSYTEYIFFRPPQKIVSPKQEHEDRKHDKVTDKGSESGTSCNELSTSSCDSHSEASTPQDNPSSAQQATAHQPNTLTLDRPSKKAPVQWIPPPDKRRNSELFQTLISKSRETNLSKKKVCEKLSVEEEMKKCIQDFKKIHIPDYFPERKRQWQSELLQKYGL

SEQ ID NO: 7332 - protein, 911 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 7333 - protein, 538 aa, Homo sapiens; identical to SEQ ID NO: 7026

SEQ ID NO: 7334 - protein, 219 aa, Homo sapiens
MASAGLQLLAFILALSGVSGVLTATLLPNWKVNVDVDSNIITAIVQLHGLWMDCTWYSTGMFSCALKHSILSLPIHVQAARATMVLACVLSALGICTSTVGMKCTRLGGDRETKSHASFAGGVCFMSAGISSLISTVWYTKEIIANFLDLTVPESNKHEPGGAIYIGFISAMLLFISGMIFCTSCIKRNPEARLDPPTQQPISNTQLENNSTHNLKDYV

SEQ ID NO: 7335 - protein, 511 aa, Homo sapiens
MKLSKKDRGEDEESDSAKKKLDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPPAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 7336 - protein, 301 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 7337 - protein, 311 aa, Homo sapiens
MGKENCTTVAEFILLGLSDVPELRVCLFLLFLLIYGVTLLANLGMTALIQVSSRLHTPVYFFLSHLSFVDFCYSSIIVPKMLANIFNKDKAISFLGCMVQFYLFCTCGVTEVFLLAVMAYDRFVAICNPLLYMVTMSQKLRVELTSCCYFCGTVCSLIHSSLALRILFYRSNVINHFFCDLPPLLSLACSDVTVNETLLFLVATLNESVTIMIILTSYLLILTTILKIHSAESRHKAFSTCASHLTAITVSHGTILYIYCRPSSGNSGDVDKVATVFYTVVIPMLNPLIYSLRNKDVNKALRKVMGSKIHS

SEQ ID NO: 7338 - protein, 1232 aa, Homo sapiens
MAEAASGAGGTSLEGERGKRPPPEGEPAAPASGVLDKLFGKRLLQAGRYLVSHKAWMKTVPTENCDVLMTFPDTTDDHTLLWLLNHIRVGIPELIVQVRHHRHTRAYAFFVTATYESLLRGADELGLRKAVKAEFGGGTRGFSCEEDFIYENVESELRFFTSQERQSIIRFWLQNLRAKQGEALHNVRFLEDQPIIPELAARGIIQQVFPVHEQRILNRLMKSWVQAVCENQPLDDICDYFGVKIAMYFAWLGFYTSAMVYPAVFGSVLYTFTEADQTSRDVSCVVFALFNVIWSTLFLEEWKRRGAELAYKWGTLDSPGEAVEEPRPQFRGVRRISPITRAEEFYYPPWKRLLFQLLVSLPLCLACLVCVFLLMLGCFQLQELVLSVKGLPRLARFLPKVMLALLVSVSAEGYKKLAIWLNDMENYRLESAYEKHLIIKVVLFQFVNSYLSLFYIGFYLKDMERLKEMLATLLITRQFLQNVREVLQPHLYRRLGRGELGLRAVWELARALLGLLSLRRPAPRRLEPQADEGGGGGSGGGGRRCLSGGCGAPEEEEEAALVERRRAGEGGEEGDGPPGGKEEDEDDEEEEDEEEEEDEEEGEEGGLLDCGLRLKKVSFAERGAGRRRPGPSPEALLEEGSPTMVEKGLEPGVFTLAEEDDEAEGAPGSPEREPPAILFRRAGGEGRDQGPDGGPDPEPGSNSDSTRRQRRQNRSSWIDPPEEEHSPQLTQAELESCMKKYEDTFQDYQEMFVQFGYVVLFSSAFPLAALCALVNNLIEIRSDAFKLCTGLQRPFGQRVESIGQWQKVMEAMGVLAIVVNCYLIGQCGQLQRLFPWLSPEAAIVSVVVLEHFALLLKYLIHVAIPDIPGWVAEEMAKLEYQRREAFKRHERQAQHRYQQQQRRRREEEERQRHAEHHARREHDSGGREEARAEGSGLDPATSSEKASAKAKGSTAGGHGPERPKRPGSLLAPNNVMKLKQIIPLQGKFLSSGATSSLAAAGAGATTRPPPAQSPTGSDTRLPAFLSFKFLKSPETRRDSERSHSPPKAFHAGKLFPFGGTRAEPGSNGAGGQARPDGTPSSGSSRVQRSGPVDEALAEELEAPRPEEEGSGTALAPVGAPALRTRRSRSPAPPPPMPLPRPPTPPAGCWQWDGPWGCGGEGAAPRQALAAAECPPCAMAGPPPAPQPLPGDASFYSLPPPPLPPTSDPLETPAPSPSPSPSPQAVCWPSGWH

SEQ ID NO: 7339 - protein, 387 aa, Homo sapiens
MAVCAKKRPPEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVRYVPSLTWGLSRESGGPIELFFSMKMKSLRSNEKSSSSCTVNI

SEQ ID NO: 7340 - protein, 488 aa, Homo sapiens
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 7341 - protein, 317 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 7342 - protein, 137 aa, Homo sapiens
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 7343 - protein, 220 aa, Homo sapiens
MVKISFQPAVAGIKGDKADKASASAPAPASATEILLTPARLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 7344 - protein, 729 aa, Homo sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 7345 - protein, 2551 aa, Homo sapiens
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 7346 - protein, 400 aa, Homo sapiens
MSKVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 7347 - protein, 233 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 7348 - protein, 162 aa, Homo sapiens
MPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 7349 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 7350 - protein, 563 aa, Homo sapiens
MRLDLASLMSAPKSLGSAFKSWRLDKAPSPQHTFPSTSIPGMAFALLASVPPVFGLYTSFFPVLIYSLLGTGRHLSTGTFAILSLMTGSAVERLVPEPLVGNLSGIEKEQLDAQRVGVAAAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGGFPQPLLPNLAELPRILADSLPIALVSFAVSASLASIHADKYSYTIDSNQEFLAHGASNLISSLFSCFPNSATLATTNLLVDAGGKTQLAGLFSCTVVLSVLLWLGPFFYYLPKAVLACINISSMRQVFCQMQELPQLWHISRVDFLLQVPGLCILSYPTPLYFGTRGQFRCNLEWHLGLGEGEKETSKPDGPMVAVAEPVRVVVLDFSGVTFADAAGAREVVQVRERLASRCRDARIRLLLAQCNALVQGTLTRVGLLDRVTPDQLFVSVQDAAAYALGSLLRGSSTRSGSQEALGCGK

SEQ ID NO: 7351 - protein, 160 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQSHWNWRTRLLGWV

SEQ ID NO: 7352 - protein, 507 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 7353 - protein, 470 aa, Homo sapiens
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGGACFTLIAGELKKPRTTIPKCIFTALPLVTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKVFLSFPLATIVIDVGLVVIPLVKSPNVHYVYVLLLVLSGLLFYIPLIHFKIRLAWFEKMTCYLQLLFNICLPDVSEE

SEQ ID NO: 7354 - protein, 414 aa, Homo sapiens
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLTQHTPGSIHPTGRRGLDLHHPLNASASWGKGLQCYLDQFLHFQVGLLIQRGQSSSVSWCIIQDRTQVS

SEQ ID NO: 7355 - protein, 659 aa, Homo sapiens
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDLLQSVKNKIFTAVLNRHVTQADLKSSTFWLRASFGATVFAVLGFAMYKALLKQR

SEQ ID NO: 7356 - protein, 798 aa, Homo sapiens
MLMLMLVAAVTMWLRPLVTAQLCRSRTVRTGKVFNLIQDVQGDRLYFHPTTTRLIKHPCEKNIALYLGKQVFFTMDNFETSLLPFTIPTSMQVGVPEVTSAHFAGSLLLLVVDQKVYIYDYENNSWSMSLGIKHPVTHVSGDNCCYTGSLFCVHVSNLVFAYFRGDQISQTYIYYSNTGGFSFWKYHYDRQAEIIGSLGGIFHFFSLSQVAMLVVNQGKGMFKYSDHPLNRSFGLSFDYNGTLDILIAPGQRGILLLWFENSLLFSHNAGQLVDTVRVKKGDQTLFSSIFEAKITIHNIAVTENELAVITREDNLYYGNLGIVPSSIIKFADQYIWSEDVALMFRSPGTLEILTPLRDTAFPAFDFQKCLVNIQALLMDPELHVGKCKIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVELWRKDSFQEVIDAEYVLLEVNGQFSYSYSLTAQSAMCTSQPQNWTTMIKEFGGPFFWNRENYVSCHDPNNNAPLRWPDVQYQILGGRTANQIIFGHNGFYVFYISIVDPYYSYCQLETIFSIYVYGAFPVQLVSAGVVILLIISSILGSVWLAYKTPKLLRTARGRRIKKCATQLCRRCKTVCQFRASATARAGTEPPGRHRTPHGGRSDH

SEQ ID NO: 7357 - protein, 1151 aa, Homo sapiens
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 7358 - protein, 401 aa, Homo sapiens
MLHLHGWQTMQGRKMGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGRLQLSLEFDFGSQEIRVGLRQAADLRPGGTVDPYARVSVSTQAGHRHETKVHRGTLCPVFDETCCFHIPQAELPGATLQVQLFNFKRFSGHEPLGELRLPLGTVDLQHVLEHWYLLGPPAATQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 7359 - protein, 428 aa, Homo sapiens
MGNCHTVGPNEALVVSGGCCGSDYKQYVFGGWAWAWWCISDTQRISLEIMTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 7360 - protein, 117 aa, Homo sapiens
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEGQSQC

SEQ ID NO: 7361 - protein, 465 aa, Homo sapiens
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 7362 - protein, 581 aa, Homo sapiens
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEIPLSMNVSTFLAYDQPTISYCGVHHELLSHKSFETNAQEDTMETHLETELDLSTITTAGRISDHKQQLA

SEQ ID NO: 7363 - protein, 393 aa, Homo sapiens
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 7364 - protein, 912 aa, Homo sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 7365 - protein, 737 aa, Homo sapiens
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 7366 - protein, 809 aa, Homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 7367 - protein, 487 aa, Homo sapiens
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWAALFLGLGVLFSLVSIPLVIYDWACSSSSDEGH

SEQ ID NO: 7368 - protein, 246 aa, Homo sapiens
MAAAAIPALLLCLPLLFLLFGWSRARRDDPHSLCYDITVIPKFRPGPRWCAVQGQVDEKTFLHYDCGNKTVTPVSPLGKKLNVTMAWKAQNPVLREVVDILTEQLLDIQLENYTPKEPLTLQARMSCEQKAEGHSSGSWQFSIDGQTFLLFDSEKRMWTTVHPGARKMKEKWENDKDVAMSFHYISMGDCIGWLEDFLMGMDSTLEPSAGAPLAMSSGTTQLRATATTLILCCLLIILPCFILPGI

SEQ ID NO: 7369 - protein, 334 aa, Homo sapiens
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGAPPTMSSGTAQPRATATTLILCCLLIMCLLICSRHSLTQSHGHHPQSLQPPPHPPLLHPTWLLRRVLWSDSYQIAKRPLSGGHVTRVTLPIIGDDSHSLPCPLALYTINNGAARYSEPLQVSIS

SEQ ID NO: 7370 - protein, 636 aa, Homo sapiens
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALMVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 7371 - protein, 1318 aa, Homo sapiens
MLRTSGLALLALVSAVGPSQASGFTEKGLSLLGYQLCSHRVTHTVQKVEAVQTSYTSYVSCGGWIPWRRCPKMVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPTGGGLSAATGVTVPGLGTGTAALGLENFTLSPSPGYPQGTPAAGQAWTPEPSPRRGGSNVVGYDRNNTGKGVEQELQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 7372 - protein, 390 aa, Homo sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 7373 - protein, 2535 aa, Homo sapiens
MVSPPLLIISVAGTIECKPDHLLWRPGSTSPQSVSFLHGKVVMESLGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 7374 - protein, 1427 aa, Homo sapiens
MGKPLSRPDCLRRNPSCLGKGEEEDGYIEDCYVPQRSIYDTMRINEQIDQGSKLNQTSKSTMEKMEGSTISSNGTLGAASNVFESRAPEGKKLDERIIFDALKLSSDVQKSAPVPPRRRPNAERKDNVNRRSWKSFMPPNFPEFAERIEASLSEVSEAGASNPSLQEKKESSSALTESSGHLDHREPQSESVTLEHVSKSIGIPEVQDFKNLSGDCQDFRFQQHSANPPHEFQPVESEAVATSGNTDVMQESRFSSATWPRATKSLAKGGFSEKQHPLGDTACTVEMPPLSPCLSEELLDPELHVLITPSLREKTESELKFEEDERWIMMEAEGEWEEEKLSDREKTFLMADEKNSLADIFEEREQANTAVVEDGSDCLAAVLRTFGHLSLGQICCPDDPQPAKDQLATVPKDIPLDCDCVLTGEDILGEVANRTAQGLEGLVSDSACTVGTIDAEQLSDTDSVQMFLELEKECLCEEGVTPLVELQNQISSEGLAASQDAENLLVISHFSGAALEKEQHLGLLHVRAKDYDTRLDCGYFNTLDSSQVPNAVELIAHVDIMRDTSTVSKEECEKVPFSPRTAEFKSRQPADLDSLEKLDPGGLLNSDHRVSHEEKLSGFIASELAKDNGSLSQGDCSQTEGNGEECIERVTFSFAFNHELTDVTSGPEVEVLYESNLLTDEIHLESGNVTVNQENNSLTSMGNVVTCELSVEKVCDEDGEAKELDYQATLLEDQAPAHFHRNFPEQVFQDLQRKSPESEILSLHLLVEELRLNPDGVETVNDTKPELNVASSEGGEMERRDSDSFLNIFPEKQVTKAGNTEPVLEEWIPVLQRPSRTAAVPTVKDALDAALPSPEEGTSIAAVPAPEGTAVVAALVPFPHEDILVASIVSLEEEDVTAAAVSAPERATVPAVTVSVPEGTAAVAAVSSPEETAPAVAAAITQEGMSAVAGFSPEWAALAITVPITEEDGTPEGPVTPATTVHAPEEPDTAAVRVSTPEEPASPAAAVPTPEEPTSPAAAVPTPEEPTSPAAAVPPPEEPTSPAAAVPTPEEPTSPAAAVPTPEEPTSPAAAVPTPEEPTSPAAAVPTPEEPTSPAAAVPTPEEPTSPAAAVPTPEEPASPAAAVPTPEEPASPAAAVPTPEEPAFPAPAVPTPEESASAAVAVPTPEESASPAAAVPTPAESASFAAVVATLEEPTSPAASVPTPAAMVATLEEFTSPAASVPTSEEPASLAAAVSNPEEPTSPAAAVPTLEEPTSSAAAVLTPEELSSPAASVPTPEEPASPAAAVSNLEEPASPAAAVPTPEVAAIPAASVPTPEVPAIPAAAVPPMEEVSPIGVPFLGVSAHTDSVPISEEGTPVLEEASSTGMWIKEDLDSLVFGIKEVTSTVLHGKVPLAATAGLNSDEVIVHFDSGKGLKSKVRFAGLTWW

SEQ ID NO: 7375 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 7376 - protein, 467 aa, Homo sapiens
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQVSSSRQSLPIKAILKSLPVWAISTGSFTFFWSHNIMTLYTPMFINSMLHVNIKENGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 7377 - protein, 889 aa, Homo sapiens
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 7378 - protein, 295 aa, Homo sapiens
MQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 7379 - protein, 199 aa, Homo sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 7380 - protein, 771 aa, Homo sapiens
MGRAGTGTGGEAVAAVVAGPLLLLLLARPPPASAGYSGKSEVGLVSEHFSQAPQRLSFYSWYGSARLFRFRVPPDAVLLRWLLQVSRESGAACTDAEITVHFRSGAPPVINPLGTSFPDDTAVQPSFQVGVPLSTTPRSNASVNVSHPAPGDWFVAAHLPPSSQKIELKGLAPTCAYVFQPELLVTRVVEISIMEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTIQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 7381 - protein, 220 aa, Homo sapiens
MALVFRTVAQLAGVSLSLLGWVLSCLTNYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGVTALVPVSWVAHKTVQEFWDENVPDFVPRWEFGEALFLGWFAGLSLLLGGCLLHCAACSSHAPLASGHYAVAQTQDHHQELETRNTNLKH

SEQ ID NO: 7382 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 7383 - protein, 1086 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 7384 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 7385 - protein, 319 aa, Homo sapiens
MEKANETSPVMGFVLLRLSAHPELEKTFFVLILLMYLVILLGNGVLILVTILDSRLHTPMYFFLGNLSFLDICFTTSSVPLVLDSFLTPQETISFSACAVQMALSFAMAGTECLLLSMMAFDRYVAICNPLRYSVIMSKAAYMPMAASSWAIGGAASVVHTSLAIQLPFCGDNVINHFTCEILAVLKLACADISINVISMEVTNVIFLGVPVLFISFSYVFIITTILRIPSAEGRKKVFSTCSAHLTVVIVFYGTLFFMYGKPKSKDSMGADKEDLSDKLIPLFYGVVTPMLNPIIYSLRNKDVKAAVRRLLRPKGFTQ

SEQ ID NO: 7386 - protein, 323 aa, Homo sapiens
MNASCCLPSVQPTLPNGSEHLQAPFFSNQSSSAFCEQVFIKPEVFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGAVTITILLGVFIFCWAPFFLHLVLIITCPTNPYCICYTAHFNTYLVLIMCNSVIDPLIYAFRSLELRNTFREILCGCNGMNLG

SEQ ID NO: 7387 - protein, 321 aa, Homo sapiens
MAPAFLLLLLLWPQGCVSGPSADSVYTKVRLLEGETLSVQCSYKGYKNRVEGKVWCKIRKKKCEPGFARVWVKGPRYLLQDDAQAKVVNITMVALKLQDSGRYWCMRNTSGILYPLMGFQLDVSPAPQTERNIPFTHLDNILKSGTVTTGQAPTSGPDAPFTTGVMVFTPGLITLPRLLASTRPASKTGYSFTATSTTSQGPRRTMGSQTVTASPSNARDSSAGPESISTKSGDLSTRSPTTGLCLTSRSLLNRLPSMPSIRHQDVYSTVLGVVLTLLVLMLIMVYGFWKKRHMASYSMCSDPSTRDPPGRPEPYVEVYLI

SEQ ID NO: 7388 - protein, 265 aa, Homo sapiens
MDGEATVKPGEQKEVVRRGREVDYSRLIAGTLPQSHVTSRRAGWKMPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAVLFQKMKAALGPWLLSLPCWPCLCLWLWFYCKGSSGEGGPLRRQKGSP

SEQ ID NO: 7389 - protein, 831 aa, Homo sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 7390 - protein, 908 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 7391 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 7392 - protein, 331 aa, Homo sapiens
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 7393 - protein, 838 aa, Homo sapiens
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEAELHHQQMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 7394 - protein, 354 aa, Homo sapiens
MTAAIRRQRELSILPKVTLEAMNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNTILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 7395 - protein, 318 aa, Homo sapiens
MMVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 7396 - protein, 1179 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 7397 - protein, 271 aa, Homo sapiens
MYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIASCLISDTRKPNRDWQTLERTSKSSGGLLKYRFLAGHGGSHL

SEQ ID NO: 7398 - protein, 382 aa, Homo sapiens
MRSHFLQWALATSRNKDQITNIFSGFAGLLAILLVVAVFCILWNWNKRKKRQVPYLRVTVMPLLTLPQTRQRAKNIYDILPWRQEDLGRHESRSMRIFSTESLLSRNSESPEHVPSQAGNAFQEHTAHIHATEYAVGIYDNAMVPQMCGNLTPSAHCINVRASRDCASISSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 7399 - protein, 161 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 7400 - protein, 1175 aa, Homo sapiens
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 7401 - protein, 667 aa, Homo sapiens
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 7402 - protein, 547 aa, Homo sapiens
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVVIYKKFQIPCPLPVLDHSVGNLSFNNTLPMHVVMLPNNSESSDVNFMMDYTHRNPAGLDENQAKGSLHDSGVEYEAHSDDKCEPKYFVFNSRTAYAIPILVFAFVCHPEVLPIYSELKDRSRRKMQTVSNISITGMLVMYLLAALFGYLTFYGEVEDELLHAYSKVYTLDIPLLMVRLAVLVAVTLTVPIVLFPIRTSVITLLFPKRPFSWIRHFLIAAVLIALNNVLVILVPTIKYIFGFIGASSATMLIFILPAVFYLKLVKKETFRSPQKVGALIFLVVGIFFMIGSMALIIIDWIYDPPNSKHH

SEQ ID NO: 7403 - protein, 1546 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLKWFPPEELNGPSPIYQLERRESSLPALMTTMMKGIRFIGNGYCKFPSSTHPVNTDFTGKCV

SEQ ID NO: 7404 - protein, 538 aa, Homo sapiens
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVISHPSDVMEIRMVKENFKARPGQYITLHCPSVSALENHPFTLTMCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 7405 - protein, 248 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 7406 - protein, 538 aa, Homo sapiens
MPALLLLVLLASSAGQARARPSNATSAEPAGPLPALLAHLRRLTGALTGGGGAASPGANGTRTGPAGGAGAAARAPPPAELCHGYYDVMGQYDATFNCSTGSYRFCCGTCHYRFCCEHRHMRLAQASCSNYDTPRWATTPPPLAGGAGGAGGAGGGPGPGQAGWLEGGRTGGAGGRGGEGPGGSTAYVVCGVISFALAVGVGAKVAFSKASRAPRAHRDINVPRALVDILRHQAGPGTRPDRARSSSLTPGIGGPDSMPPRTPKNLYNTVKTPNLDWRALPPPSPSLHYSTLSCSRSFHNLSHLPPSYEAAVKSELNRYSSLKRLAEKDLDEAYLKRRPLELPRGTLPLHALRRPGTGGGYRMEAWGGPEELGLAPAPNPRRVMSQEHLLGDGGRSRYEFTLPRARLVSQEHLLLSSPEALRQSREHLLSPPRSPALPPDPTARASLAASHSNLLLGPGGPPTPLRGLPPPSSLHAHHHHALHGSPQPAWMSDAGGGGGTLARRPPFQRQGTLEQLQFIPGHHLPQHLRTASKNEVTV

SEQ ID NO: 7407 - protein, 1124 aa, Homo sapiens
MSSYFWAQNESNRPDLLCGQPADYLVEEKHFTTLVCFIVVLGGLLKMCLKNCEVIVLTILSLSGFVIGHMAYNSVEVHQIVYPLLRTSSFSLYSYFSPLIIFMVALDVEFYTLKKMFWQVLLTGLISFSTASIIIGYVVIKFNKDSWDLQSCLLFSITLGIIDPLRSVNSLKTIGISKIYIDLIRGESLIICSIASIFFGNFRGNRIHFSIFRDLHVGIELSYDILGSIIFGYWCAKIIQCILADVFSNMLTNIILCFSMVYMTFYIVEFLGMSGTLALAAVGLNLDSLTFKPKIELVITKFLRIFSSVYEHLIYAFFGIVIGCGELSHYEFHTIPFIFILFTTVNLVRLLTILLVSPILMHSNYEYNWRWGVVITWSGIKGVFNLLWAPDVYNLAERKVEVPQMFILYVQVISLLTMGINSYVMTQSARKLDLCVLSLPRQMILQNATQHIQEIVQNTITLFKTEKILTNVNWTLVEDKTRIEYIPFSHVSHNDMKTESTTDEALMEEARLHVAAIQMSSFEKQRNNGILEIEAARILIGAAKCYYSIQGKFMSIYDVSTYMRTRSWLIKFKNVLTFLEYCIEKIHFIPPESNTFLTFIFHIVFSEEFEYTGQIINLIYIYPMIIHLWPMARGLNVSALISINYYFMFLYVLESTLKIIILKRKYFQQCWNTLEFFILVIGIIDIFCVYFVKLRPDNLALIQLTVIMGYLRIIRFLPLFKIIVPILIRIADVQIKKRLSLMYSITKGYIKSQEDAKLLIKQIAVCESIYQKLCEILETNKQDAVKELVLMEHEGRDVVIALKTKQAIRNVIAKALKNLTFLCSRGIIDKHEVIEINKVLLKKLKALNNFPKAIPPPTPDIYLHNIIWLEGKDVLIDFFKERAKLACFDSGDTICKGGEMPQGIYLIISGMAILHSLSPTFGIESNQRCDRGSRDMFTEFCTTGDIIGELSCLLKREIEYTVICETSLQACFISLEDLYEGFDAFWPSLEYKIWLKLALSTAYQYFESSLIDEDLRFQNCVMFNQAYVETLSSYSDMIIDNMTMKFVIIVYGSVIDTKTEEPYFAPCIIPTTCEQVQGTSDLSKLLIIQASELTQRNSNTNVMASVNTVFEQPGKNINGRQKMS

SEQ ID NO: 7408 - protein, 235 aa, Homo sapiens
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 7409 - protein, 923 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTNQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 7410 - protein, 590 aa, Homo sapiens
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 7411 - protein, 870 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 7412 - protein, 1257 aa, Homo sapiens
MENSERAEEMQENYQRNGTAEEQPKLRKEAVGSIEIFRFADGLDITLMILGILASLVNGACLPLMPLVLGEMSDNLISGCLVQTNTTNYQNCTQSQEKLNEDMTLLTLYYVGIGVAALIFGYIQISLWIITAARQTKRIRKQFFHSVLAQDIGWFDSCDIGELNTRMTDDIDKISDGIGDKIALLFQNMSTFSIGLAVGLVKGWKLTLVTLSTSPLIMASAAACSRMVISLTSKELSAYSKAGAVAEEVLSSIRTVIAFRAQEKELQRYTQNLKDAKDFGIKRTIASKVSLGAVYFFMNGTYGLAFWYGTSLILNGEPGYTIGTVLAVFFSVIHSSYCIGAAVPHFETFAIARGAAFHIFQVIDKKPSIDNFSTAGYKPESIEGTVEFKNVSFNYPSRPSIKILKGLNLRIKSGETVALVGLNGSGKSTVVQLLQRLYDPDDGFIMVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKASKGRTTIVVAHRLSTIRSADLIVTLKDGMLAEKGAHAELMAKRGLYYSLVMSQDIKKADEQMESMTYSTERKTNSLPLHSVKSIKSDFIDKAEESTQSKEISLPEVSLLKILKLNKPEWPFVVLGTLASVLNGTVHPVFSIIFAKIITMFGNNDKTTLKHDAEIYSMIFVILGVICFVSYFMQGLFYGRAGEILTMRLRHLAFKAMLYQDIAWFDEKENSTGGLTTILAIDIAQIQGATGSRIGVLTQNATNMGLSVIISFIYGWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPEKYNTQVGLKGAQLSGGQKQRLAIARALLQKPKILLLDEATSALDNDSEKVVQHALDKARTGRTCLVVTHRLSAIQNADLIVVLHNGKIKEQGTHQELLRNRDIYFKLVNAQSVQ

SEQ ID NO: 7413 - protein, 783 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEEESEPEQDTKVFARILRAPESHNVTFGSFVTLHCTATGIPVPTITWIENGNAVSSGSIQESVKDRVIDSRLQLFITKPGLYTCIATNKHGEKFSTAKAAATISIAEWREYCLAVKELFCAKEWLVMEEKTHRGLYRSEMHLLSVPECSKLPSMHWDPTACARLPHLAFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 7414 - protein, 540 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 7415 - protein, 557 aa, Homo sapiens
MEVTAVGEEANQGDLLGFGQRCCSLGSSNPWLYRTAGIFPEHCTEEKKIGTYFRVAPQASKSQRSRCHGMAASEARPGEATAASYGRPFPTHPRRQEFRARVVRGPTMLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 7416 - protein, 639 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 7417 - protein, 364 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 7418 - protein, 424 aa, Homo sapiens
MRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRALADVMRPQGHCNTDHMERDLNIVVHVQHYENMDTRTPINNLHATQMNNAVPTSPLLQQMGHPHSYPNLGQISNPYEQQPPGKELNKYASLKAVGSSDGDWAVSTLKSPKADKVNDDFYTKRRHLAELAAKGNLPLHPVRVEDEPRAFSPEHGPAKQNGQKSRTNKMPPHPLAYTSTTNFKGWDPNEQSLRRQAYSNKGKLGTAETGSSDPLGTRPQHYPPPQPYFITNSKTEVTV

SEQ ID NO: 7419 - protein, 172 aa, Homo sapiens
MAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 7420 - protein, 365 aa, Homo sapiens
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 7421 - protein, 1118 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 7422 - protein, 220 aa, Homo sapiens
MALIFRTAMQSVGLLLSLLGWILSIITTYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGITALVPVSWVAHKTVQEFWDENVPDFVPRWEFGEALFLGWFAGLSLLLGGCLLNCAACSSHAPLALGHYAVAQMQTQCPYLEDGTADPQV

SEQ ID NO: 7423 - protein, 263 aa, Homo sapiens
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLEQME

SEQ ID NO: 7424 - protein, 661 aa, Homo sapiens
MSHVAVENALGLDQQFAGLDLNSSDNQSGGSTASKGRYIPPHLRNREATKGFYDKDSSGWSSSKDKDAYSSFGSRSDSRGKSSFFSDRGSGSRGRFDDRGRSDYDGIGSRGDRSGFGKFERGGNSRWCDKSDEDDWSKPLPPSERLEQELFSGGNTGINFEKYDDIPVEATGNNCPPHIESFSDVEMGEIIMGNIELTRYTRPTPVQKHAIPIIKEKRDLMACAQTGSGKTAAFLLPILSQIYSDGPGEALRAMKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEESDKRSFLLDLLNATGKDSLTLVFVETKKGADSLEDFLYHEGYACTSIHGDRSQRDREEALHQFRSGKSPILVATAVAARGLDISNVKHVINFDLPSDIEEYVHRIGRTGRVGNLGLATSFFNERNINITKDLLDLLVEAKQEVPSWLENMAYEHHYKGSSRGRSKSRFSGGFGARDYRQSSGASSSSFSSSRASSSRSGGGGHGSSRGFGGGGYGGFYNSDGYGGNYNSQGVDWWGN

SEQ ID NO: 7425 - protein, 479 aa, Homo sapiens
MLTSKGQGFLHGGLCLWLCVFTPFFKGCVGCATEERLFHKLFSHYNQFIRPVENVSDPVTVHFEVAITQLANVIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 7426 - protein, 950 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQNVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 7427 - protein, 533 aa, Homo sapiens
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHNYSQDAADACDIDEIEEVPTTSHRLSRHDKAVQRFCLIGSLSKHESEYNTTRV

SEQ ID NO: 7428 - protein, 454 aa, Homo sapiens; identical to SEQ ID NO: 7124

SEQ ID NO: 7429 - protein, 65 aa, Homo sapiens
MLLVLLSVVLLALSSAQSTDNDVNYEDFTFTIPACRKHHHSSRGTDQQDIPRSNHSGNLEFSGRK

SEQ ID NO: 7430 - protein, 259 aa, Homo sapiens
MALRRPPRLRLCARLPDFFLLLLFRGCLIGAVNLKSSNRTPVVQEFESVELSCIITDSQTSDPRIEWKKIQDEQTTYVFFDNKIQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 7431 - protein, 478 aa, Homo sapiens
MYRDPEAASPGAPSRDVLLVSAIITVSLSVTVVLCGLCHWCQRKLGKRYKNSLETVGTPDSGRGRSEKKAINGTLLSGAKVAAAAGLAVEREGRLGEKPAPVPPPGEDALRSGGAAPSEPGSGGKAGRGRWRTVQSHLAAGKLNLSKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 7432 - protein, 107 aa, Homo sapiens
MASASTTMHTTTIAEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 7433 - protein, 283 aa, Homo sapiens
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKFISGFQS

SEQ ID NO: 7434 - protein, 824 aa, Homo sapiens
MRLALLWALGLLGAGSPLPSWPLPNIVLSWGVLGPAGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 7435 - protein, 1211 aa, Homo sapiens
MPLPDGARTPGGVCREARGGGYTNRTFEFDDGQCAPRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGGCRTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 7436 - protein, 389 aa, Homo sapiens
MKNYKAIGKIGEGTFSEVMKMQSLRDGNYYACKQMKQRFESDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 7437 - protein, 1037 aa, Homo sapiens
MTVGFNSDISSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 7438 - protein, 188 aa, Homo sapiens
MNGDDTFAKRPRDDAKASEKRSKAFDDIATYFSKKEWKKMKYSEKISYVYMKRNYKAMTKLGFKVTLPPFMCNKQATDFQGNDFDNDHNRRIQVEHPQMTFGRLHRIIPKIMPKKPAEDENDSKGVSEASGPQNDGKQLHPPGKANISEKINKRSGPKRGKHAWTHRLRERKQLVIYEEISDPEEDDE

SEQ ID NO: 7439 - protein, 422 aa, Homo sapiens
MHGREAGPFVCVCVLLASIPTPQTPLLQASLPPFHPASAGHPITGQQDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 7440 - protein, 101 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 7441 - protein, 816 aa, Homo sapiens
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 7442 - protein, 210 aa, Homo sapiens
MQAEGRGTGGSTGDADGPGGPGIPDGPGGNAGGPGEAGATGGRGPRGAGAARASGPRGGAPRGPHGGAASAQDGRCPCGARRPDSRLLELHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 7443 - protein, 736 aa, Homo sapiens
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 7444 - protein, 702 aa, Homo sapiens; identical to SEQ ID NO: 7239

SEQ ID NO: 7445 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 7446 - protein, 80 aa, Homo sapiens
MGRAMVARLGLGLLLLALLLPTQIYSSETTTGTSSNSSQSTSNSGLAPNPTNATTKAAGGALQSTASLFVVSLSLLHLYS

SEQ ID NO: 7447 - protein, 2367 aa, Homo sapiens
MGTRGAVMPPPMWGLLGCCFVCAWALGGPRPIRSLPPLSSQVKPGSVPMQVPLEGAEAALAYLYSGDAQQLSQVNCSERYEARGAGAMPGLPPSLQGAAGTLAQAANFLNMLLQANDIRESSVEEDVEWYQALVRSVAEGDPRVYRALLTFNPPPGASHLQLALQATRTGEETILQDLSGNWVQEENPPGDLDTPALKKRVLTNDLGSLGSPKWPQADGYVGDTQQVRLSPPFLECQEGRLRPGWLITLSATFYGLKPDLSPEVRGQVQMDVDLQSVDINQCASGPGWYSNTHLCDLNSTQCVPLESQGFVLGRYLCRCRPGFYGASPSGGLEESDFQTTGQFGFPEGRSGRLLQCLPCPEGCTSCMDATPCLVEEAAVLRAAVLACQACCMLAIFLSMLVSYRCRRNKRIWASGVVLLETVLFGFLLLYFPVFILYFKPSVFRCIALRWVRLLGFAIVYGTIILKLYRVLQLFLSRTAQRSALLSSGRLLRHLGLLLLPVLGFLAVWTVGALERGIQHAPLVIRGHTPSGRHFYLCHHDRWDYIMVVAELLLLCWGSFLCYATRAVLSAFHEPRYMGIALHNELLLSAAFHTARFVLVPSLHPDWTLLLFFFHTHSTVTTTLALIFIPKFWKLGAPPREEMVDEVCEDELDLQHSGSYLGSSIASAWSEHSLDPGDIRDELKKLYAQLEVHKTKEMAANNPHLPKKRGSSCQGLGRSFMRYLAEFPEALARQHSRDSGSPGHGSLPGSSRRRLLSSSLQEPEGTPALHKSRSTYDQRREQDPPLLDSLLRRKLAKKASRTESRESVEGPPALGFRSASAHNLTVGERLPRARPASLQKSLSVASSREKALLMASQAYLEETYRQAKEREERKKAKAAMASLVRRPSARRLERPRGAPLSAPPSPAKSSSVDSSHTSGRLHEEARRRLPHPPIRHQVSTPILALSGGLGEPRMLSPTSTLAPALLPALAPTPAPALAPVPVSPQSPNLLTYICPWENAELPAKQENVPQEGPSGPERGHHSPAPARARLWRALSVAVEKSRAGENEMDAEDAHHQREANDVDEDRPKIFPKSHSLKAPVQQGSMRSLGLAIKALTRSRSTYREKESVEESPEGQNSGTAGESMGAPSRSPRLGRPKAVSKQAALIPSDDKESLQNQQNAHTSRMLQVCQREGSREQEDRGRRMTQGLGERKAERAGKTGLAMLRQVSRDKNIKQSKETPVGWQELPKAGLQSLGSADHRVAEVCPWEVTESETRQPDSGNKAEICPWETSEGAPESRALRQDPGDSQKKRGEARGKSEPIDVVPMMRKKPERLVREQEAVCPWESADRGGLSPGSAPQDPGRIRDKSEAGDSVEARKVEKPGWEAAGPEAHTPDITKAEPCPWEASEGGEDGKPAQEAVKDLPQEKQKTRKATFWKEQKPGGDLESLCPWESTDFRGPSAVSIQAPGSSECSGSLGSGIAEVCLWEAGDAPAIQKAEICPWELDDNVMGQEMLSLGTGRESLQEKEKASRKGSFGEMGEQTVKAVQKLSQQQESVCPRESTVPGHSSPCLDNSSSKAGSQFLCNGGSRATQVCPQEDLRPEAQEATPAKTEICPWEVNERTREEWTSAQVPRGGESQKDKEKMPGKSEIEDVTAWEKPEGQIQKQEAVGPWESVDPGSFSPQPRPQDTERPQTLLQMSGSVGSKAADICPLDVEENLTAGKAEICPWEVGAGAGEERALGAEAIRKSPNDTGKVSADLGPRERAVTAPEKPQKPTPEWEVACPWGSVGPGACSQHPGTLDADGPKAGFQELDHMGCRPGEVCPWEAQEAATSEKAKICPWEVSEGTTGKGLDQKAGSESAEQREKALEKGRLTSLGEDVSKGMAKLCQQQETICIWENKDLRESPAQAPKISDLPSSMSSEVAEGHSLEATEKGDLRQDPKTGSFPEHITQEKAPAADTEEFTTEDGEKTSHELQSVCPWETTAPADSVSHLDRQRPDQPKASSQRLVSTGGRAADVCPWDVPDAGVYKSDSSAKAETCPWEVTERIPVKGVSRQDGKGDSQEEKGRAPEKSEPKGVPVQKKPEMADFRQQEAVCPWESQDGKGLSPQPAPDASDRSRGSSEAAGSVETRVAEVCLWEVVEAPSAKKAEICPWEAGGGAAEEGEQERESQGQGEMFLQKAGPGGTEEHFSKAAAKPREQEAVCPGEGTGSGGLLPQSGALDPELKVSPKEAGSMGSRMAELCQWEITDPEGNKIKGTMADICPGEETGVPSEESGLLALTATRREFFPTAPEKPLCLLVHGPLDHFFPESKIPCPKVSRPASTFTLEGVRELQGPSGLEPRTSLAPEPSLQEAESQSSSLTEDSGQVAFEAQYEEFTPPTVYPWDWE

SEQ ID NO: 7448 - protein, 1069 aa, Homo sapiens
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKPGDGAIAVDELQDNKKLKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 7449 - protein, 797 aa, Homo sapiens
MEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVPFVITLGSILLLGLLVYLVVLLAKAIHRHCPCKTGKNKEPLTKKGETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 7450 - protein, 801 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTAFPLKNAEDLDIGQNNIENYIISPNSYFRVLTRKRSDGRKYPELVLDKALDREEEAELRLTLTALDGGSPPRSGTAQVYIEVVDVNDNAPEFEQPFYRVQISEDSPISFLVVKVSATDVDTGVNGEISYSLFQASDEISKTFKVDFLTGEIRLKKQLDFEKFQSYEVNIEARDAGGFSGKCTVLIQVIDVNDHAPEVTMSAFTSPIPENAPETVVALFSVSDLDSGENGKISCSIQEDLPFLLKSSVGNFYTLLTETPLDRESRAEYNVTITVTDLGTPRLTTHLNMTVLVSDVNDNAPAFTQTSYTLFVRENNSPALHIGSVSATDRDSGTNAQVTYSLLPPQDPHLPLASLVSINTDNGHLFALRSLDYEALQAFEFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPCSATATLHVLLVDGFSQPYLPLPEAAPAQGQADSLTVYLVVALASVSSLFLFSVLLFVAVLLCRRSRAASVGRCSVPEGPFPGHLVDVRGTGSLSQNYQYEVCLAGGSGTNEFQLLKPVLPNIQGHSFGPEMEQNSNFRNGFGFSLQLK

SEQ ID NO: 7451 - protein, 296 aa, Homo sapiens
MWLLGPLCLLLSSAAAKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYNVNNGIQYVASQAEQNASEVGSPPSYSEALLDQRPAWYDLPPPPYSSDTESLNQADLPPYRSRSGSANSASSQAASSLLSVEDTSHSPGQPGPQEGTAEPRDSEPSQGTEEV

SEQ ID NO: 7452 - protein, 65 aa, Homo sapiens
MHTSTSSSVTKSYISSQTNGETGQLVHRFTVPAPVVIILIILCVMAGIIGTILLISYTIRRLIKA

SEQ ID NO: 7453 - protein, 194 aa, Homo sapiens
MWVKLLSIVAEFCFSPFLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 7454 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 7455 - protein, 367 aa, Homo sapiens
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMFGPEGALKHMLKEGKGRMLQAISPKQSPSSSPTRERSPSPSFRWPFSGKTSPPCSPANLSRHKAAAYDISEDEED

SEQ ID NO: 7456 - protein, 962 aa, Homo sapiens
MNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 7457 - protein, 1042 aa, Homo sapiens
MSVLKFELDNFSPEGFRHEHASNSCFALPCLTELSGDSSQLELQHSSSVPTGLQKLCFSHRELEKSVWAAKGKYNEGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 7458 - protein, 64 aa, Homo sapiens
MAAAASPAFLLCLPLLHLLSGWSRAGWVEPPSLAPGTTQPKAMATTLSPWSLLIIFLCFILAGR

SEQ ID NO: 7459 - protein, 244 aa, Homo sapiens
MMGIFLVYVGFVFFSVLYVQQGLSSQAKFTEFPRNVTATEGQNVEMSCAFQSGSASVYLEIQWWFLRGPEDLDPGAEGAGAQVELLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGMETHFEPFILPLTNAPQKGQSYRVDRFMNGDF

SEQ ID NO: 7460 - protein, 423 aa, Homo sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 7461 - protein, 948 aa, Homo sapiens
MILVLVKALSDVCAGTSGFLLDFSSQTSPGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 7462 - protein, 406 aa, Homo sapiens
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 7463 - protein, 658 aa, Homo sapiens
MLRMRVPALLVLLFCFRGRAGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 7464 - protein, 159 aa, Homo sapiens
MMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 7465 - protein, 167 aa, Homo sapiens
MGPGRCLLTALLLLALAPPPEASQYCGRLEYWNPDNKCCSSCLQRFGPPPCPELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 7466 - protein, 188 aa, Homo sapiens
MDCRKMVRFSYSVIWIMAISKAFELGLVAGLGHQEFARPSRGDLAFRDDSIWPQEEPAIRPRSSQRVLPMGIQHSKELNRTCCLNGGTCMLESFCACPPSFYGRNCEHDVRKENCGSVPHDTWLPKKCSLCKCWHGQLRCFPQAFLPGCDGLVMDEHLVASRTPELPPSARTTTFMLAGICLSIQSYY

SEQ ID NO: 7467 - protein, 236 aa, Homo sapiens [sequence omitted]

SEQ ID NO: 7468 - protein, 2471 aa, Homo sapiens; identical to SEQ ID NO: 5027

SEQ ID NO: 7469 - protein, 2321 aa, Homo sapiens
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 7470 - protein, 2003 aa, Homo sapiens; identical to SEQ ID NO: 3075

SEQ ID NO: 7471 - protein, 2470 aa, Mus musculus
MPDLRPAALRALLWLWLCGAGPAHALQCRGGQEPCVNEGTCVTYHNGTGFCRCPEGFLGEYCQHRDPCEKNRCQNGGTCVPQGMLGKATCRCAPGFTGEDCQYSTSHPCFVSRPCQNGGTCHMLSRDTYECTCQVGFTGKQCQWTDACLSHPCENGSTCTSVASQFSCKCPAGLTGQKCEADINECDIPGRCQHGGTCLNLPGSYRCQCGQGFTGQHCDSPYVRGLPCVNGGTCRQTGDFTLECNCLPGFEGSTCERNIDDCPNHKCQNGGVCVDGVNTYNCRCPPQWTGQFCTEDVDECLLQPNACQNGGTCTNRNGGYGCVCVNGWSGDDCSENIDDCAYASCTPGSTCIDRVASFSCLCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEVNECQSNPCVNNGQCVDKVNRFQCLCPPGFTGPVCQIDIDDCSSTPCLNGAKCIDHPNGYECQCATGFTGILCDENIDNCDPDPCHHGQCQDGIDSYTCICNPGYMGAICSDQIDECYSSPCLNDGRCIDLVNGYQCNCQPGTSGLNCEINFDDCASNPCMHGVCVDGINRYSCVCSPGFTGQRCNIDIDECASNPCRKGATCINDVNGFRCICPEGPHHPSCYSQVNECLSNPCIHGNCTGGLSGYKCLCDAGWVGVNCEVDKNECLSNPCQNGGTCNNLVNGYRCTCKKGFKGYNCQVNIDECASNPCLNQGTCFDDVSGYTCHCMLPYTGKNCQTVLAPCSPNPCENAAVCKEAPNFESFSCLCAPGWQGKRCTVDVDECISKPCMNNGVCHNTQGSYVCECPPGFSGMDCEEDINDCLANPCQNGGSCVDHVNTFSCQCHPGFIGDKCQTDMNECLSEPCKNGGTCSDYVNSYTCTCPAGFHGVHCENNIDECTESSCFNGGTCVDGINSFSCLCPVGFTGPFCLHDINECSSNPCLNAGTCVDGLGTYRCICPLGYTGKNCQTLVNLCSRSPCKNKGTCVQEKARPHCLCPPGWDGAYCDVLNVSCKAAALQKGVPVEHLCQHSGICINAGNTHHCQCPLGYTGSYCEEQLDECASNPCQHGATCNDFIGGYRCECVPGYQGVNCEYEVDECQNQPCQNGGTCIDLVNHFKCSCPPGTRGLLCEENIDECAGGPHCLNGGQCVDRIGGYTCRCLPGFAGERCEGDINECLSNPCSSEGSLDCVQLKNNYNCICRSAFTGRHCETFLDVCPQKPCLNGGTCAVASNMPDGFICRCPPGFSGARLQSSCGQVKCRRGEQCIHTDSGPRCFCLNPKDCESGCASNPCQHGGTCYPQRQPPHYSCRCPPSFGGSHCELYTAPTSTPPATCQSQYCADKARDGICDEACNSHACQWDGGDCSLTMEDPWANCTSTLRCWEYINNQCDEQCNTAECLFDNFECQRNSKTCKYDKYCADHFKDNHCDQGCNSEECGWDGLDCASDQPENLAEGTLIIVVLLPPEQLLQDSRSFLRALGTLLHTNLRIKQDSQGALMVYPYFGEKSAAMKKQKMTRRSLPEEQEQEQEVIGSKIFLEIDNRQCVQDSDQCFKNTDAAAALLASHAIQGTLSYPLVSVFSELESPRNAQLLYLLAVAVVIILFFILLGVIMAKRKQAWLPLAAGRFTLRRDSSNHKRREPVGQDAVGLKNLSVQVSEANLIGSGTSEHWVDDEGPQPKKAKAEDEALLSEDDPIDRRPWTQQHLEAADISHTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADRNAQDNMGRCPLHAAVAGDAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVLCGPNRSFLSLKHTPMGKKARRPNTKSTMPTSLPNLAKEAKDAKGSRRKKCLNEKVQLSESSVTLSPVDSLESPHTYVSDATSSPMITSPGILQASPTPLLAAAAPAAPVHTQHALSFSNLHDMQPLAPGASTVLPSVSQLLSHHHIAPPGSSSAGSLGRLHPVPVPADWMNRVEMNETQYSEMFGMVLAPAEGAHPGIAAPQSRPPEGKHMSTQREPLPPIVTFQLIPKRSIAQAAGAPQTQSSCPPAVAGPLPSMYQIPEMPRLPSVAFPPTMMPQQEGQVAQTIVPTYHPFPASVGKYPTPPSQHSYASSNAAERTPSHGGHLQGEHPYLTPSPESPDQWSSSSPHSASDWSDVTTSPTPGGGGGGQRGPGTHMSEPPHSNMQVYA

SEQ ID NO: 7472 - protein, 1964 aa, Mus musculus
MQPQLLLLLLLPLNFPVILTRELLCGGSPEPCANGGTCLRLSQGQGICQCAPGFLGETCQFPDPCRDTQLCKNGGSCQALLPTPPSSRSPTSPLTPHFSCTCPSGFTGDRCQTHLEELCPPSFCSNGGHCYVQASGRPQCSCEPGWTGEQCQLRDFCSANPCANGGVCLATYPQIQCRCPPGFEGHTCERDINECFLEPGPCPQGTSCHNTLGSYQCLCPVGQEGPQCKLRKGACPPGSCLNGGTCQLVPEGHSTFHLCLCPPGFTGLDCEMNPDDCVRHQCQNGATCLDGLDTYTCLCPKTWKGWDCSEDIDECEARGPPRCRNGGTCQNTAGSFHCVCVSGWGGAGCEENLDDCAAATCAPGSTCIDRVGSFSCLCPPGRTGLLCHLEDMCLSQPCHVNAQCSTNPLTGSTLCICQPGYSGSTCHQDLDECQMAQQGPSPCEHGGSCINTPGSFNCLCLPGYTGSRCEADHNECLSQPCHPGSTCLDLLATFHCLCPPGLEGRLCEVEVNECTSNPCLNQAACHDLLNGFQCLCLPGFTGARCEKDMDECSSTPCANGGRCRDQPGAFYCECLPGFEGPHCEKEVDECLSDPCPVGASCLDLPGAFFCLCRPGFTGQLCEVPLCTPNMCQPGQQCQGQEHRAPCLCPDGSPGCVPAEDNCPCHHGHCQRSLCVCDEGWTGPECETELGGCISTPCAHGGTCHPQPSGYNCTCPAGYMGLTCSEEVTACHSGPCLNGGSCSIRPEGYSCTCLPSHTGRHCQTAVDHCVSASCLNGGTCVNKPGTFFCLCATGFQGLHCEEKTNPSCADSPCRNKATCQDTPRGARCLCSPGYTGSSCQTLIDLCARKPCPHTARCLQSGPSFQCLCLQGWTGALCDFPLSCQMAAMSQGIEISGLCQNGGLCIDTGSSYFCRCPPGFQGKLCQDNMNPCEPNPCHHGSTCVPQPSGYVCQCAPGYEGQNCSKVLEACQSQPCHNHGTCTSRPGGFHCACPPGFVGLRCEGDVDECLDRPCHPSGTAACHSLANAFYCQCLPGHTGQRCEVEMDLCQSQPCSNGGSCEITTGPPPGFTCHCPKGFEGPTCSHKALSCGIHHCHNGGLCLPSPKPGSPPLCACLSGFGGPDCLTPPAPPGCGPPSPCLHNGTCTETPGLGNPGFQCTCPPDSPGPRCQRPGASGCEGRGGDGTCDAGCSGPGGDWDGGDCSLGVPDPWKGCPPHSQCWLLFRDGRCHPQCDSEECLFDGYDCEIPLTCIPAYDQYCRDHFHNGHCEKGCNNAECGWDGGDCRPEGEDSEGRPSLALLVVLRPPALDQQLLALARVLSLTLRVGLWVRKDSEGRNMVFPYPGTRAKEELSGARDSSSWERQAPPTQPLGKETESLGAGFVVVMGVDLSRCGPEHPASRCPWDSGLLLRFLAAMAAVGALEPLLPGPLLAAHPQAGTRPPANQLPWPILCSPVVGVLLLALGALLVLQLIRRRRREHGALWLPPGFIRRPQAQQAPHRRRPPLGEDNIGLKALKPEAEVDEDGVAMCSGPEEGEAEETASASRCQLWPLNSSCGELPQAAMLTPPQECESEVLDVDTCGPDGVTPLMSAVFCGGVQSTTGASPQRLGLGNLEPWEPLLDRGACPQAHTVGTGETPLHLAARFSRPTAARRLLEAGANPNQPDRAGRTPLHTAVAADAREVCQLLLASRQTSVDARTEDGTTPLMLAARLAVEDLVEELIAARADVGARDKRGKTALHWAAAVNNARAARSLLQAGADKDAQDSREQTPLFLAAREGAVEVAQLLLELGAARGLRDQAGLAPGDVARQRSHWDLLTLLEGAGPTTQEARAHARTTPGGGAAARCRTLSAGARPRGGGACLQARTWSVDLGARGGKVYARCRSRSGSCGGPTTRGRRFSAGSRGRRGARASQDDWPRDWVALEACGSACSAPIPPPSLTPSPERGSPQVAWGLPVHQEIPLNSVVRNLN

SEQ ID NO: 7473 - protein, 2318 aa, Mus musculus
MGLGARGRRRRRRLMALPPPPPPMRALPLLLLLAGLGAAAPPCLDGSPCANGGRCTHQQPSLEAACLCLPGWVGERCQLEDPCHSGPCAGRGVCQSSVVAGTARFSCRCLRGFQGPDCSQPDPCVSRPCVHGAPCSVGPDGRFACACPPGYQGQSCQSDIDECRSGTTCRHGGTCLNTPGSFRCQCPLGYTGLLCENPVVPCAPSPCRNGGTCRQSSDVTYDCACLPGFEGQNCEVNVDDCPGHRCLNGGTCVDGVNTYNCQCPPEWTGQFCTEDVDECQLQPNACHNGGTCFNLLGGHSCVCVNGWTGESCSQNIDDCATAVCFHGATCHDRVASFYCACPMGKTGLLCHLDDACVSNPCHEDAICDTNPVSGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSMCQLDVDECASTPCRNGAKCVDQPDGYECRCAEGFEGTLCERNVDDCSPDPCHHGRCVDGIASFSCACAPGYTGIRCESQVDECRSQPCRYGGKCLDLVDKYLCRCPPGTTGVNCEVNIDDCASNPCTFGVCRDGINRYDCVCQPGFTGPLCNVEINECASSPCGEGGSCVDGENGFHCLCPPGSLPPLCLPANHPCAHKPCSHGVCHDAPGGFRCVCEPGWSGPRCSQSLAPDACESQPCQAGGTCTSDGIGFRCTCAPGFQGHQCEVLSPCTPSLCEHGGHCESDPDRLTVCSCPPGWQGPRCQQDVDECAGASPCGPHGTCTNLPGNFRCICHRGYTGPFCDQDIDDCDPNPCLHGGSCQDGVGSFSCSCLDGFAGPRCARDVDECLSSPCGPGTCTDHVASFTCACPPGYGGFHCEIDLPDCSPSSCFNGGTCVDGVSSFSCLCRPGYTGTHCQYEADPCFSRPCLHGGICNPTHPGFECTCREGFTGSQCQNPVDWCSQAPCQNGGRCVQTGAYCICPPGWSGRLCDIQSLPCTEAAAQMGVRLEQLCQEGGKCIDKGRSHYCVCPEGRTGSHCEHEVDPCTAQPCQHGGTCRGYMGGYVCECPAGYAGDSCEDNIDECASQPCQNGGSCIDLVARYLCSCPPGTLGVLCEINEDDCDLGPSLDSGVQCLHNGTCVDLVGGFRCNCPPGYTGLHCEADINECRPGACHAAHTRDCLQDPGGHFRCVCHPGFTGPRCQIALSPCESQPCQHGGQCRHSLGRGGGLTFTCHCVPPFWGLRCERVARSCRELQCPVGIPCQQTARGPRCACPPGLSGPSCRVSRASPSGATNASCASAPCLHGGSCLPVQSVPFFRCVCAPGWGGPRCETPSAAPEVPEEPRCPRAACQAKRGDQNCDRECNTPGCGWDGGDCSLNVDDPWRQCEALQCWRLFNNSRCDPACSSPACLYDNFDCYSGGRDRTCNPVYEKYCADHFADGRCDQGCNTEECGWDGLDCASEVPALLARGVLVLTVLLPPEELLRSSADFLQRLSAILRTSLRFRLDARGQAMVFPYHRPSPGSESRVRRELGPEVIGSVVMLEIDNRLCLQSAENDHCFPDAQSAADYLGALSAVERLDFPYPLRDVRGEPLEAPEQSVPLLPLLVAGAVFLLIIFILGVMVARRKREHSTLWFPEGFALHKDIAAGHKGRREPVGQDALGMKNMAKGESLMGEVVTDLNDSECPEAKRLKVEEPGMGAEEPEDCRQWTQHHLVAADIRVAPATALTPPQGDADADGVDVNVRGPDGFTPLMLASFCGGALEPMPAEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHLANREITDHLDRLPRDVAQERLHQDIVRLLDQPSGPRSPSGPHGLGPLLCPPGAFLPGLKAVQSGTKKSRRPPGKTGLGPQGTRGRGKKLTLACPGPLADSSVTLSPVDSLDSPRPFSGPPASPGGFPLEGPYATTATAVSLAQLGASRAGPLGRQPPGGCVLSFGLLNPVAVPLDWARLPPPAPPGPSFLLPLAPGPQLLNPGAPVSPQERPPPYLAAPGHGEEYPAAGTRSSPTKARFLRVPSEHPYLTPSPESPEHWASPSPPSLSDWSDSTPSPATATNATASGALPAQPHPISVPSLPQSQTQLGPQPEVTPKRQVMA

SEQ ID NO: 7474 - protein, 2471 aa, Rattus norvegicus
MPALRPAALRALLWLWLCGAGPAHALQCRGGQEPCVNEGTCVTYHNGTGYCRCPEGFLGEYCQHRDPCEKNRCQNGGTCVTQAMLGKATCRCAPGFTGEDCQYSTSHPCFVSRPCQNGGTCHMLSWDTYECTCQVGFTGKQCQWTDVCLSHPCENGSTCSSVANQFSCRCPAGITGQKCDADINECDIPGRCQHGGTCLNLPGSYRCQCPQRFTGQHCDSPYVPCAPSPCVNGGTCRQTGDFTSECHCLPGFEGSNCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCLCPEGKAGLLCHLDDACISNPCHKGALCDTNPLNGQYICTCPQAYKGADCTEDVDECAMANSNPCEHAGKCVNTDGAFHCECLKGYAGPRCEMDINECHSDPCQNDATCLDKIGGFTCLCMPGFKGVHCELEVNECQSNPCVNNGQCVDKVNRFQCLCPPGFTGPVCQIDIDDCSSTPCLNGAKCIDHPNGYECQCATGFTGTLCDENIDNCDPDPCHHGQCQDGIDSYTCICNPGYMGAICSDQIDECYSSPCLNDGRCIDLVNGYQCNCQPGTSGLNCEINFDDCASNPCLHGACVDGINRYSCVCSPGFTGQRCNIDIDECASNPCRKDATCINDVNGFRCMCPEGPHHPSCYSQVNECLSSPCIHGNCTGGLSGYKCLCDAGWVGINCEVDKNECLSNPCQNGGTCNNLVNGYRCTCKKGFKGYNCQVNIDECASNPCLNQGTCLDDVSGYTCHCMLPYTGKNCQTVLAPCSPNPCENAAVCKEAPNFESFTCLCAPGWQGQRCTVDVDECVSKPCMNNGICHNTQGSYMCECPPGFSGMDCEEDINDCLANPCQNGGSCVDKVNTFSCLCLPGFVGDKCQTDMNECLSEPCKNGGTCSDYVNSYTCTCPAGFHGVHCENNIDECTESSCFNGGTCVDGINSFSCLCPVGFTGPFCLHDINECSSNPCLNSGTCVDGLGTYRCTCPLGYTGKNCQTLVNLCSPSPCKNKGTCAQEKARPRCLCPPGWDGAYCDVLNVSCKAAALQKGVPVEHLCQHSGICINAGNTHHCQCPLGYTGSYCEEQLDECASNPCQHGATCSDFIGGYRCECVPGYQGVNCEYEVDECQNQPCQNGGTCIDLVNHFKCSCPPGTRGLLCEENIDDCAGAPHCLNGGQCVDRIGGYSCRCLPGFAGERCEGDINECLSNPCSSEGSLDCIQLKNNYQCVCRSAFTGRHCETFLDVCPQKPCLNGGTCAVASNVPDGFICRCPPGFSGARCQSSCGQVKCRRGEQCVHTASGPHCFCPNHKDCESGCASNPCQHGGTCYPQRQPPYYSCRCSPPFWGSHCESYTAPTSTPPATCLSQYCADKARDGICDEACNSHACQWDGGDCSLTMEDPWANCTSSLRCWEYINNQCDELCNTAECLFDNFECQRNSKTCKYDKYCADHFKDNHCDKGCNNEECGWDGLDCAADQPENLAEGILVIVVLLPPEQLLQDSRSFLRALGTLLHTNLRIKQDSQGALMVYPYYGEKSAAMKKQKVARRSLPDEQEQEIIGSKVFLEIDNRQCVQDSDQCFKNTDAAAALLASHAIQGTLSYPLVSVVSESEDPRNTPLLYLLAVAVVIILFLILLGVIMAKRKRKHGFLWLPEGFTLRRDSSNHKRREPVGQDAVGLKNLSVQVSEANLIGSTTSEHWGDDEGPQPKKAKAEDDEALLSEDDPVDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVLCGPNRSFLSLKHTPMGKKARRPNTKSTMPTSLPNLAKEAKDVKGSRRKKCLNEKVQLSESSVTLSPVDSLESPHTYVSDATSSPMITSPGILQASPTPLLAAAPAAPVHAQHALSFSNLHEMQPLRPGASTVLPSVSQLLSHHHIVPPGSGSAGSLGRLHSVPVPSDWMNRVEMSETQYSEMFGMVLAPAEGTHPGMAAPQSRAPEGKPIPTQREPLPPIVTFQLIPKGSLAQAAGAPQTQSGCPPAVAGPLPSMYQIPEMARLPSVAFPPTMMPQQEGQVAQTIVPTYHPFPASVGKYPTPPSQHSYASSNAAERTPNHGGHLQGEHPYLTPSPESPDQWSSSSPHSASDWSDVTTSPTPGGGGGGQRGPGTHMSEPPHSNMQVYA

SEQ ID NO: 7475 - protein, 2319 aa, Rattus norvegicus
MGPGARGRRRRRRLMALPPPPPPMRALPLLLLLLAGLGAAAPPCLDGSPCANGGRCTHQQPSREAACLCLPGWVGERCQLEDPCHSGPCAGRGVCQSSVVAGVARFSCRCLRGFRGPDCSLPDPCFSSPCAHGAPCSVGSDGRYACACPPGYQGRNCRSDIDECRAGASCRHGGTCINTPGSFHCLCPLGYTGLLCENPIVPCAPSPCRNGGTCRQSSDVTYDCACLPGFEGQNCEVNVDDCPGHRCLNGGTCVDGVNTYNCQCPPEWTGQFCTEDVDECQLQPNACHNGGTCFNLLGGHSCVCVNGWTGESCSQNIDDCATAVCFHGATCHDRVASFYCACPMGKTGLLCHLDDACVSNPCHEDAICDTNPVSGRAICTCPPGFTGGACDQDVDECSIGANPCEHLGRCVNTQGSFLCQCGRGYTGPRCETDVNECLSGPCRNQATCLDRIGQFTCICMAGFTGTFCEVDIDECQSSPCVNGGVCKDRVNGFSCTCPSGFSGSTCQLDVDECASTPCRNGAKCVDQPDGYECRCAEGFEGTLCERNVDDCSPDPCHHGRCVDGIASFSCACAPGYTGIRCESQVDECRSQPCRYGGKCLDLVDKYLCRCPPGTTGVNCEVNIDDCASNPCTFGVCRDGINRYDCVCQPGFTGPLCNVEINECASSPCGEGGSCVDGENGFHCLCPPGSLPPLCLPANHPCAHKPCSHGVCHDAPGGFQCVCDPGWSGPRCSQSLAPDACESQPCQAGGTCTSDGIGFHCTCAPGFQGHQCEVLSPCTPSLCEHGGHCESDPDQLTVCSCPPGWQGPRCQQDVDECAGASPCGPHGTCTNLPGSFRCICHGGYTGPFCDQDIDDCDPNPCLNGGSCQDGVGSFSCSCLSGFAGPRCARDVDECLSSPCGPGTCTDHVASFTCTCPPGYGGFHCETDLLDCSPSSCFNGGTCVDGVNSFSCLCRPGYTGTHCQYKVDPCFSRPCLHGGICNPTHSGFECTCREGFTGNQCQNPVDWCSQAPCQNGGRCVQTGAYCICPPEWSGPLCDIPSLPCTEAAAHMGVRLEQLCQAGGQCIDKDHSHYCVCPEGRMGSHCEQEVDPCTAQPCQHGGTCRGYMGGYVCECPTGYSGDSCEDDVDECASQPCQNGGSCIDLVAHYLCSCPPGTLGVLCEINEDDCGPGPSLDSGLRCLHNGTCVDLVGGFRCNCPPGYTGLHCEADINECRPGTCHAAHTRDCLQDPGGHFRCICLPGFTGPRCQTALFPCESQPCQHGGQCRPSLGRGGGLTFTCHCVQPFWGLRCERVARSCRELQCPVGIPCQQTARGPRCACPPGLSGPSCRVSRASPSGATNTSCAATPCLHGGSCLPVQSVPFFRCVCAPGWGGPRCETPSAAPEVPEEPRCPRAACQAKRGDQNCDRECNSPGCGWDGGDCSLNVDDPWRQCEALQCWRLFNNSRCDPACSSPACLYDNFDCYSGGRDRTCNPVYKKYCADHFADGRCDQGCNTEECGWDGLDCASEVPALLARGVLVLTVLLPPEELLRSSADFLQRLSAILRTSLRFRLDARGQAMVFPYHRPSPGSESRVRRELGPEVIGSVVMLEIDNRLCLKSAENDHCFPDAQSAADYLGALSAVERLDFPYPLRDVRGEPLEPPEQSVPLLPLLVAGAVFLLVIFVLGVMVARRKREHSTLWFPEGFALHKDIAAGHKGRREPVGQDALGMKNMTKGESLMGEVATDWNDSECPEAKRLKVEEPGMGAEEPVDCRQWTQHHLVAADIRVAPAMALTPPQGDADADGMDVNVRGPDGFTPLMLASFCGGALEPMPAEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPSGPHGLGPLLCPPGAFLPGLKAVQSGTKKSRRPPGKTGLGPQGTRGRGKKLTLACPGPLADSSVTLSPVDSLDSPRPFGGPPASPGGFPLEGPYATTATTVSLAQLGASRAGPLGRQPPGGCVLSLGLLNPVAVPLDWARLPPPAPPGPSFLLPLAPGSQLLNPATPVSPHERPPPYLAAPGHGEEYPAAGTHSSPTKARFLRVPSEHPYLTPSPESPEHWASPSPPSLSDWSDSTPSPATATSATAAGALPAQPHPISVPSLPQSQTQLGPQPEVTPKRQVMA
